United States Patent 11,583,558 (METHODS AND COMPOSITIONS FOR TREATMENT OF MICROBIOME-ASSOCIATED DISORDERS) - sequence listing, part 10

SEQ ID NO: 10 - DNA, 6402828 bp, Clostridium indolis WBS-01 (residues 2,134,277-4,268,552 of 6,402,828)
ttccagcatgctctttgtctgtccataaggattggtgatctttcccttggggcagtcttccgtgatgggtacaaaggccggatccccgtatacagtggcagaggagctgaatatgatattcttcaccttatgttccctcatgacatcgcacaggttcagagttccggtaatgttattgtgataatattccaaaggttttacaaccgattctcccacagcctttaaccctgcaaaatggattacagcatcgatcacctcataatcaaatatctcatctaatgcatctttgtctaaaaggtctgcctcataaaaggccaccgttttcccggtaatggcttctacccgttccaatgaaaccctggaggaattgcaaagattatccaccacaacaacctcgtggccctgttccaaaagttcgatacatgtatggctgccgatgtatccggcgcctccggttaccaatattctcatgttctctcctctttcttattcatattttaatacctataaatcaaacggatatacaagtatatccagttgacacccaatgaagcgggaatgcaaacactcccatttgacccaaaatacaagagcaaaacatttatttttcactcctgcggacgatttcctccatttccttccacttcttttccatgtcagccacaagtgcaaactgggtcctggtccggtccagattgtggttttctctgcttatatgaaaataggtatctccctgaagaaaatccgttaaaaaacgcatgccgcactcaaaggtcatcagctttgcccccatgggaagcatctgtttttcctccggcgtcaggcttcccttgcacccttctaaatatccttttgtataaatctcaaacaagggcagggataaggatactttgcttacatcaggctcatcctcctctgccgtattggccccgaaacggatggaatccccgaagtcaaagatcgataagccgggcatgatggtatctaagtcaatgatgcaaagggcttccccggtaacatcatcgatcataatgttgttaagcttggtatcgttatgggtgacacagagagggagcctgccagcctttaacatatccatggcaatggacgcctccttctccctgtcaaggacgaattttatttcctcctcaaccagatgggcgcggccgcatacatcggcctttacagccgccttaaacgtttccatgcgaaccggagtgttatgaaaattgggtatggtttccgacagttcatcagccggatactgggccagctggcgtttaaaccgcccgaatgccttgccgctctggtaaaaatcctccggattcctcaccttatcataggtggtggccccttcaataaaaagataacctctccagtaattcccgtcgccatcctggcagtaatcctttccatcccttgcctttattatattaagcgtctccctggacggatctccgccctgggcctcgatccgttcccgcagaaaggaagtgacacccgcaatgtttttcataagagaaaccggatccttaaagacctcatggttgatcctctggatgatgtagtgtttttccccttctccgattttgcagatcaggcgaaacgtatcattaatatggccgcttccatagcgcatccatgagaccggctccccctcaaaggccagaagtccgatagcctctttaatctttccgcactgtgcgtctcccattacatttcctcccatagcttttccggatacagaccggcttctttcaatcctttgatggcattcactactgtttccttatcttccttgtaggtgacaccgtaccagcggtccacactctttaatacggaaacctctgccttgccttcctttaacagttcatccaccacaaagggaaggaagtattcacattttaccggatttttgggaagctccctgtctaaaaatgcggcaaaccgttgttcaagctcttttaatatgctgtttgtaaaaccccacatattcatggaaacgatggtatcctctgaaagcccggtccaggttttcccatcatcctcggtaaattctgccttgccgccgtgcttttcgattctggtccgctcattgatatcaacaagctttccatcttcatcggtgctgcacacgcctcttgccacatggccgttttccgtcagggtgttgtaaagctggtagcccaccatggtgtactgatacttctctccgtcagaaaccctgttaagctggtcataaatggatacaaaagcacttctgccataaaaatcatctgcattaatgactgcaaagggtccgtcaatggcatccttgcagcataaaatggcatgtcctgttccccagggcttcactcttccctccggcacctcatatccctttggaagcttaccaagctcctgatatacgtactccacctgtacatgcgccgccatgcggtctccgatgttttccttaaattctttttcaatgtcctttttaataataaagacaaccttttcaaatcctgcacaaaccgcatcataaatagaaaaatcaatgatcttgtttccatgggcatctacagggtcaatctgctttaagcccccgtagcggcttcccatgcctgctgccatgattaccagaaccggtttcttgttcatcgctgttacctcctaaattctaatatcctcagtataatgaatgcgtgtcaaaagatatttgcactatttattatttaatttgtattatcgtactcttctcaccatttcatcacggattatggtataatgattgctgtccaatcattataccacaatcccgtcaaccggaaggaggtttccatggcatacaaaagcacctcgctgcgttcctctgctgtcgttaaaaagatcataaccatccactattttgagtatatgagcgatttctcctttcctggagaaagccatgatttctgggagtttgtctgcgttgacaagggggtcatcgatgtaatggccggagacaaacggatccctttaaaacggggaaacatcatcttccacaagcccggagagttccacaacatactgacaaacgggaccgttgcccctaatctggtggtggtgagctttgaatgcaattccccttatatgaaggcctttgaaggagaagtcttatccgtacaggaaacggaaatggctttgctggcacaaatcatcattgaggcgcggaatgcatttgcagggcggcttgacgatccttaccaggaagagctggtcagaaggcagcctcccctgtcctttggggcggagcagcttatcggcaattatctggaagagctgatcatccatctttaccgcagatactttataaagccccagcagatctccaccggacgggtcatggaaagccccatgcacggagatgcccataaccgcatcgtccggtatatggaagaacatatcggagagcaccttaccattgaagccatctgccgggataatttaaccggacggtcacagcttcagaaaatcttccataatgcctatggctgcggggtcatggatttcttcatcggaatgaagatcgatgcagccaagcagctcatccgcagcaatcagctgaatttcactgaaattgcggaccgtttgggctacacctcggtccattatttttccaggcagtttaaaaagctgaccgggatgacgccgtcggaatacgctacctccatccgttctctttcggaaaagggcacagaggcatgtttgcccggctcctcctttgagtaaataggaaaaggcgggaattctccccgcctaacctacttttaatttgaatttctttgcttcattttcagagtccactttttcaattatggcaccaaggccctgaagcttttcttcaaagcattcatagccccgttggatgtatccgatctcatccacaactgtataaccatccgcagccagcccggcaatcaccagagccgcacctgcacggagatcaggagcattgacaaatgctccggtaaaaccgactacgccgtcaataacggctacgttaccctctacctttacattggctcccatgcgtgataattcatccacataacggaaacggttctcaaaaatgctctctgtgaccacactggtgccttttgcaagggcaagggtcaccgtcatctgaggctgcatatctgtggggaatcccggatagggaagggttttgatgtccgtatgcctttggttggttttccctacaacacggaccgcgtcatcgaattccaccacctcgcatcccatttccagaagctttgcagaaatggcttccaaatgctttggaatgacgtttttcaccataacatcacccctggtaatggctgcagcgcacataaaggtgcctgcttcgatctggtccgggatgatggaatactcagttccatggagctttctcactccccggatgcggatggtatccgtaccggcgcccttgatgttggcacccatgctgtttaaaaagtttgccacgtcaaccacatgaggctcttttgccacgttttccagaattgtctgtccctcggcaagggtcgcagccatcataacgttgatggtggccccaacgcttacaacgtccaaatagatatggctcgccaccagatcaatggcatgggcgatcacagctccccgttcaatcctcacatcagctccaagggcgcggaatccctttaaatgctggtcaatgggcctgcttccaatgttgcagcctcccggaagggggacctgggcgcttttatacttacccagcatggcaccgataaagtagtaggaggccctgatcttacggatgtaatcatcatcaaccgagacctcccgaatggtctttccattgatgcggaccgtatgcctgtcaatccgctctactcttgctccaatctcctctatggcttcaagcaacacgtttatatctctgacatcaggcagattatcgatcagaacatcttcatctgtcatgatcgctgctgccagaattcccaaagcggcattctttgccccgccgatggtcacttcgcccaccaggggatttccgcccttcataatatactgctccatttcacacctctgattatcatgttatctatttacaaatttcttaaatttcatccattagcctttaatgattataacatatcttacgaatttgtaaagagaacgcattttcttattccgtaaatactccgcagacaaagtcatttccctggcctgcaaagtatgcagaggcatcatttaagcccattttctggctctctccggataccgggttgtagacagtcacattataggaatcataaccggaaaggagcacataaccgccctgaaggttgtaggcggccaccggacagccgtgaccgataaaatataatacctggcttaaggtgcagcccctggcatccatcatgagaaccccttccccatagaaactgtctgacttaaaaccttccagattccggataaaggctgctcctgtttttaaaggctctttcatattgcgggagggcggacggtttacccggttccataggatttcctggttcttatcggtcacgactcccattttatcataggcaagagctaaagcatcagtaaatctgcggctgcttccaagataacgccctcctccgtaggcataaaacatgttctcctggaaccttccattgctctttaattccacgacttccgtggtttcatacgccacctttttaggaaccgtgatctttacctccttgccttccgtgtctttatccagctggacaaaataaagctttctccggtcctccgatgcgtaccagccaatcccctccatctctccgtttgtaagctcctgattgcagacaatggtatcctgcctggaggcaacataggactggtctcctgatttggccacctgagttaaatgaatccggctgtcatccacggatacatctgcaatataaacattctcattttcatattcctttacgatctttccgctttggtccatgatctcgatccggtacatgggggcatcctttgttctcccgttttgcacccacacatcgccttttttggcaatcccgtaaatgaaatcgtctcccacgaacccaaggggcctgtaaatgttatcctccccgccggttatttccctcttcactcctgtatccagatccatgaggtgaaccactccggctccgtaaaggtcactgccttcctgccatgcaaagcggcgttctgtactgctgaccgcatatccgccctccgccagggagtccgccaggaccatgtattcattgctgtttaaatcaatgccgtaaactgcccggtccgccattaaataaagcattccgttggctcccacatgagccagctggtctatatcttccttaagcatctcaaaggacagggtcacaggagtgaagaaacgttctgttgtggcgttgtcctggatgctgtactgatacatggcaatccctaagccgccctcatggatccctctgttcatgtatccgtaaaccagaaaattcacatccccgttatcgctgaccgacaagaccttaatatcgtgctggttatagctgctgcgcagcccatcgtcttcgccgcttcggaaagagaacacctttaccccatgctccttactctggtcaaaggtccacagatcccggtttaccacataggccagccaatcccctgacgggctttttgcagtccgtatctcatcctggttggaaatgcccagcaggatccgtttcccggaaaacagccccttttggccggaaaatatctgattggtattccgctcaaagtccatgaggtagatgcgcctgctgtcccatttcatggtaaagctgtcctccacctcatacagctcctgaatgccgtcttctccctccctggatatctcataatccagctggacactgcacatgattccgtttaaatcctttaaggtcgccctgatgtctccttccggcttcacagaaagccctccccaggtaagctgggaaaagctggaccggatggtcacatgaccaagggagctgttatcctctccctcactggtttccagataagtggtaagctgccgggcctggtcataatcaaaggttttggtggtgaaatccactgcgaagtcaatcatgtcctttacattggtgctgtctgtccacatgatgcgggtataataaaggagttttccgttccctgaggtatccagcgacaggattaaaaggtattccttatcctttgtcaaaagattctggataggaagcgtcgccgtgacgcttccttcctcctggttccacttatctaccgttgtccgttccaccagacgccccagatccatgctgcggacctcatattccagcccctggatactgcctttgtagtcagatatctgtatgttcatggctctgtcaggcggcaggactgtaagagcttccctggaaaccgcctgcttcatgtcctgtgtatagccatggagaaggttcatctttcttccgtacatatgggaatatactacgggcagagaagcttcatccatggaggtatataccataacatcacttttttctgtatttttttgatcccacacaaaataaactgcgatcgccgcaataaaaaccgcagataatatccctattttttttattaatcgactcatccaaaacttcctctgtttccgtatttttgtacactaatgaatcaagcgggtatgcagggatatccggtcgattcgtaaacgaggggtgaaagataggtttctttcaaccttatactctcttatactctttattgtatacaataatatccaaaactacaacgaaaactttcttaaacattcgttaagcggccacggaataaccaggcttcaaaccacataaaaaagcagctatcctgccataaaccgacaagtaactgcttttcttttccttatttgcaaagtccgctgcggcatctcctgcggtgcatctcattgataaggagcacattgaccacaccgttcagccagccatcattgtaacgcggcccccgcgggccccatggcccccatggtcttttagatcccggcggacagcacggcggttcccatggccttcctggtcccggcggaccccacgtgcttcccggtccccacggtccttttgatccaggaggcccccacggtcctctccgtcccggatgccttcctggaggtccccatggcggcggaccccaacgggaatcccggtcctgtgactgcatatccgtttcatctgtctcgtcttcctcccagtccatctgttccgttgcatctacagacgcctgttctgtatcttctgcttcctccgtcatttcatccattatgacaccatccctgtgtatctgatcgcatatggaatcgcagatctggttgatcattatacggtccggatattcgtcatacatgggactgtttttataatccagatgatcacacgctgaaactacatattcctgcaaacgcttcatatgtcccgggtacatcccctggagatattccaaatcctgtacaatgagatcctttctttccatcgggcgccctgcagcactcctgtcgccataaagcatatatggctccagttcctgaaagttgtttccataagtataatccgggttaatcggcacggtcgttatcactccctgctttctgcttatacaaaaccattgtatgcaaaacacacagaaaaagtgcagaattcccgggaaacgaaacacggcgttgtgacaacctgccagctgtcacaacgccgtttatcactcttaacttatgtcaaacaaacgctccggatatactccttctgataccaggttcctgatcgctgccgcaacagccggtttgtcctccttataggtcacaccaaaccaccggtcctttgtttcaaggacttttacctgagctttttgggaatgaacaagcttatcaataatttttggaagcaggtactccgtcttcacatccccttcctttaagctgtctaaaaatcccggaaatcctctctccagctcctcaagaaacgccggggaaagtccccacatgttcatggaaacattctggcttaagggaattactacaggagtcccttcctcgctgcggccttctgcccggtcttcccgctgcctgatttcgtaggtttctgtaaccctttccagtatcccattttcatccacctggcatactccccgggtcactccccattctcgcttagggtgttgcccagaataaatcctcccatgcagatatcaaaaggttttgacgccggatccatctcatttaccaggtattcatgaatctttataaaaccttcttttccataatagtcatccgcattgatcacgacaaatggttcatgaatcaccggtttcgcgcataaaagagcttgtccggttccccatggcttggttcttccctctggttttgtatagccttcaggaaggtcatccagttcctgataagcgtactccacaggagcaattttttcgatcctgtttccgatgatttccttaaagtcctgttccagatcttttcttataatgaacacaactttgtcaaatccagctttcaaagcatcatatatggaatagtccataatgatctccccgcttggtcctacaggttccagctgtttgattcccccgccgaacctgcttccgatgccagctgccataatcactaatgatgttttcttcataacactctctccctgttagattaatctgcctaatagtatatcacaaaagaaagggttaatccatagataacggaatttgtcccctttccctcactttaccggttatgaaaatgaaaaaagagatttaaacccgttttataaggtccaaatctctctttctttactttgtaagcgaaagccttataagggcctttctcaaagctgtttctgctcttataatatcaatctctccgctctgttcctttaagcggcgttctgcacggaccttagcctcttctgctcggcttgcgtcgatttctccgggccattctgcaacttccgccataatgacgatcttttccggtaaaatctcaataaagccggacatcagggctgcttccttcactccgccctcctcgtgaatctttaagactcccggggcaacaatggcagtcatggggatatgattccggtatacaccgatttccccttccgtggtagtaagctccaccatggaagcatctccctcgtaaaacttccgttccggagtgatgatatgcagtttaaataaatcagccatattcccaccccctattttttcacgcgggcaagaacgtcctcaatgctgcctgcatttaagaaatagctctccggaatgtcatcatgttttccttccagaatctccttaaagccctgaatggtatcagaaagcggcacatagcggccttccagaccggtaaactgtcctgcaacgaagaaaggctgagacaggaatctctggatctttcttgcgcgggctaccgtgattttatcttcctcagaaagttcatccatacctaacatggcgatgatatcctgaagttctttatatttctgaagtacttcctgaacaccacgcgctacgcggtagtgctcctcacctacgattcgcggatcaagaattcttgaagtggaaccaaggggatcaaccgccggatatatacccagctccacgatggaacggtcaagaaccgtggtcgcatccagatgggcgaaggtgttggccggagccgggtccgtaaggtcatcggccggaacgtaaactgcctgaaccgatgtgatggaaccattcttcgtggaggtgattctctcctgaagagcacccatctcagtctgcagggtcggctgatagcctactgcggaaggcatacgtccaagcaaagcggaaacctcggaacctgcctgggtgaaacggaaaatgttgtcaatgaacaacagcacatccttaccgccctgatcacggaaatactcagccatggtaagtccggttaggcccactctcatacgggctcccggcggctcgttcatctgtccgaacaccatggttgttttattgataacgcctgattcctgcatctcgtgataaaggtcatttccttcacgggtgcgctcgccaacgccggtgaatacggaatatccgccgtgctctgtggcaatgttacggatcagctcctgaattaatacggttttacctactccggcaccgccgaaaaggccgatcttaccgcccttttgataagggcagagaaggtcgacgaccttaataccggtttccagaacctctgtttccgttgactgcgcctcaaagcttggtgccggtctgtgaatcggaaaacgttcctttacttccggtgccggttttttatcgattggatcacccagaacgttaaagattcgtcccagagtctcctctccaaccggtacggtaataggagcgccggtagctaccgcgtccataccacgtaccagtccatcggtggttcccatggcgatacatcttactgtatcatcgccaagatgctgggatacttctacaaccagtctgccgccatccttagtcgtgatatcaatggcctcattgatatccggcagcttgccctggctgaacttgatatccagtacggcaccgatgatctgggtgatcttaccaatattttgtcctgccatcttgtttctccttctttttatatttctctcgttcattacctcgaacggctattttcctaaattcaagctgcgccttcgcttgctttcattaagtaaaatatgccaaggaagtttggttcgccttatgaaatcgcattggcacctgctatgatctccgtaagctcctgggtaatggaaccctgtcttgcccggttatatgccagtccaagctcttctatcatctcttccgcattgttggttgcagaatccatggctgtcatcctggctccgttttcactggcaacggcctccagcaaagcgccatagatcaggctgctcatatactttggaataatggaatccaatacctgatcctcatccggctcataattcattaaggtcagatccatcttttcacttccctctgccaattcaaccgggagaagctttttaagggtcggtatatgggtcactgtattcttaaaagatgtatatgccagataaatttcacctatccggtcctgtccaaaggcgtccagaagctccatggtaatatcggccgcatcccggtagatcggttcattgatcacctcagaataatcctcagcgatggtataaccctttcttgccagtgcttctttccccttccgtccaacggcgtaaacatctgtcagttccggcgtaagccttttatctccattcaccagcttgacaatgttgctgttatagccgcctgccagaccccggtttgaagtgatgacaatgactgcctttctctcagagccgcctgcctttaaatacttatggtcaatactgccggatttgcgcagcatggaacctatggtatcatacatcatgccgtaatagggtttggattcctctgcctttgctttggacttctgcagcttaacggtagatatgagcttcatggcttttgtaatctgttcggtactggaaatactgtctcttcttcgtttgatatccctaatggatgccatgattgttcacctgcctttaaaaaacgcctgctttacattcgttgattgcctttaccagcaattcctccgtctcaggcgtgatctgcttcgtctcgcggatgcttacagggatttcagaatatttgctgtcaatgaagctggtcaaagccttttcaaaatcaaggattttaccagtaggtatatccaggagaagcttcctggtcgccgcaaagataatgatgatctggtattcaaccggaatcggctgatactgaccctgctttaatacttctctgatcctctcgccctgagcaagctgttcagccgtctccttatcaagctcggaaccaaactgcgcaaagcttgcaagttcgcggtactgcgccagttccacacggatgggagctgcgatcttcttcattgccttgatctgggcggagccgcctacacgggatacggaaagacctgcattgatggcaggacggaagccggagttaaacatttctgtctccagataaatctgtccgtctgtaatggaaataacgttggtaggaatataagcggatacgtcacccgcctgtgtctcaatgattggaagtgctgttaaggagcctcctcccatttcttctgaaagcctggaagctctctccaaaagtctggaatggagatagaaaacatcgcccgggtaagcctcacggcccggcggtctcttaagcagcagggacagggtacggtaagctgccgcatgtttacttaagtcatcgtaaacaaccagcacgtccccgccgttttccatccattcctctccaatggcacatccggaataaggagcaatgtactgaagtggagcaagatcggaagcggttgataccacgacggtcgtataatccatggctccatactcttccaatgttttaacaatggttgcaactgtagatgacttctggccgatggctacataaatacaatgaacccctggcccttctgattaatgatggtatcaagggcaatcgccgtcttacctgtctggcggtcgccaatgatcagctcacgctgtcctcttccgatgggaatcatggcatcaatagccttaatacctgtctgaaggggagtatctactgattttctgtcaataactccgtgagccacacgctcaatcttacggaatttgtctgtctggaccggtccctttccatcaatgggctgtcctaacgcatttacaacacggccggttaatgcatcgcctacaggcacttccaccactcgtccggtagtcttgacggtatcgccctcgctgatcgcgccggtacccagtaaaaccgcaccaacgttatcttcttccaggttgagcaccatgccgtaaatttctcccgggaactcaagaagctctccctgcatggcattctcaaggccatggatacgggcaattccgtcagccacctgaatgactgtaccgacatcagagacatccagtttcgttgaatacctttgaatctgttccttgatgacagaactgatctcttctggtcttaaattcattaaggtttgcaccttctttctaagattattaatgaagtccgatcggccagacggccctccggacaactgatttcctaaattcagactgggccttcccaaaaatcatggactgaaaaaaggaaatcatgtcagctgcagctttaacaagctgcggcgcaaatcgtaaatctgcgtcttaacgctggaatccaccacccggtctccgatccggatcaccattccgccaatgagtgacgggtctacctgataatccatctcaaattccacataggtcgtcgtattcagcagtttttctgcaagacgggccttttgcccctcacttaactcaacagcgctggtcacatgggccacgccgatattcttatattccttgacagcgtttacgaagtattcacaaattgccggaatctccttctgtctgcctttgtcgacaatgactgccagaaaacccatcagatcatccgatacgcgtccgtcaaaaatattcttaataatgccgattttctcttcctttacaatcttcggattatcaagaagctccgccaatgactgattctcacgccagatcatctgcaggcctttcacttcctcaaataaagcgtccacttcctgctttcttaaggcttcctcaaacaatgcatcgccgtatacttttgatactagctttgccatgtgctctcacccatctctttcaaagtctcgtcaatcagggcatcctgcaccgtagtgtcaatggaagcagccacgaccttaccggccataagagaagctatggatatgatctgatccttcatatcatcaagcgctttctttctctccagttccacctcgcggttgccccgtgtaacaatgcggtccgcttcttccctggcttctgcaataatttctgcttcacgctgcttcgctctttttctggcatcctctaagattgcttctgcttctttcttcacttcctgaagtctggcctcgtattcttccttcattgcatgcgcagcttccttatcgtcggcagcactttttaattctcccgcgatcttctgttttcttctttccagggcttcccgtaccggattgaacagcatataggataacgcgaagaacaagatgaatatgttgacgcctgtcacaaatgaatcgaaaagcagctgtgggtcaaatcccaataatcgttccaaggtttcgcctcctctcgctctttattctttccctgttctgcggggcggcttttgcacccgccattccattctttagctgaatggctttaagaacatgaggatagcagcaacagcgaaaccataaagacctgttgtctcggcaacggcctgtcctaaaagcatggtagatgtaatatcagattttgctcccggattgcgtccaactgcagcagccgcatgtcctgccgctataccctgtccaataccaggtccgatacctgcgatcatcgcaagacctgcaccgattgctgagcaacctaagataaaatcctgtcctgaaaaaccgttcatagaaaaattcctcctgaatttaatattattgaagtttaatccatcttatcattgacatataccatagtcagcatacagaacacataagtctgaatacagcctgagaatatgtcacaatatacatgtaaaaatgatgggataccgatctttacaaaaattggcatcatcccataccacaaccccatgataacaacacccgacatcatgttgccgaataaacggagcgcctgggataatgggtttgtaatttcaccgattaagttaatcgggaacaaaaccggaaacggcttaaacatgcttgtgagatgaccgattccatgattcttgattccctggtattgcaccatgcagaatgtgaaaactccaagcatgaatgtaacaccaaagtcacccgttggcgttctaagaccaaataagccgccaatattgcagaacaatatgaaaataaatatagtcccaatataattaacaaacttttttgcattgtgacccatcgtaccgtttaccaggctgtcaagcgactccacggcaagctccacaatattctgaaaggtgcctggtacttctgtggcccgcttcattttccggttagcaagcactgctattattaaaattacgattgtcacaatgctaaggcctatttctgtggtagtaatccaaagctcctgtccaaaggcctgaaactttgtaacgcctttgatcataaagtccacattattggcactcgcaacgaccatacgcttaatcctcctttcttaagagatcccacttgaccgcaaaggagatcactctccctttgccctacggacagcgatcttgtggatggcaggctgtaaaaatgccccagccttgagtccgaggactccgattactactgcgaccggattaaaccagttggaaaaccggataataactgtcaccagtataacaataagcagtaaatagcggatgactgcactgatcacactccgcttctgaacagtctttggatcctccgtcttcatagagcgctcaagaaccaaagccatggataaaaacatggccatagctattatcatacccaaaagtaatcccgcaaaaacagtacgatcgggatacataaaaaatgccaccaccatagctgccgcagtgaaaaatacaattccggccgaaacctcaagcatcagattctttgtttccttccccattacaagtcctcctgtctacgaaagcttctcatcgtcatgtcctttcacccggcttggctgcttcggtttatgcaccttgggtctttcttcctcctgccgctccatgcgagacttctgatcttcttcccgttcttccctttcattcatggcaagggtggacttcgccagcttataagcatttaagcctcctgccagaaatccgagaaacagaaataataaagtcagctttgtccccgcataccggtcaatgtagtaaccggcaagaatacaaaaaaatacaggcgccatgacactcaaccccagttgggtcaccatcatgaaacttctcattacgctcttattatggcgcataattccacctgctttctgcatcctgcacatatacttggtattatacctaaaaaaatttgttttgtctattatatacggaaatttatctgggttttaaaggaagatgtatataataccaaaaattgtatatctattataaatcaataccttaaaaaaatattgacacgccaaaaaactccaatattttgcatgtttaaaacagaaaatccctaaaaaaaattctggtttttacgagaatgactcataaaaaccagacctttttcaaatttctatttacgcttcttttgtacccggaagaattgtttcaacttctgcatgtggacgaggaattacatgcacggataccagctcgcctacgcgctgagctgctgctgcacctgcatcggtcgctgccttaacagctcctacgtcgcctcttaccataacggtaacaagaccgccgcctacaaactccttgccgatcagggtaacgttcgctgcttttaccatagcatctgctgcttcgatggatccaatcaaaccttttgtttcaatcattcctaatgcatcgtatttcattttataatcctcctatttataattaatttttaatggttctcttactttacaatagttacgcttgaagaactgccaagtcccatggcatttgcttcttccgtatcaagatggcattccaggctggatgtatcggttacgcggattgccgtatggtgaaagatgccgccccggattccctctgtctgaatgcttactgtctgtccgtcatgaacgccgaatttcatggcatcctgaggagtcatgtgaatatgtctttgggcaatgatcagcccttctcttgtctgaacggagcccttgggtcccaccagggtgatccccggtgtgccggttaattcgccggacattttaggctgagaatttgttccaagcttaaaacagtcggccgccagaacctcgatctgagtctgtcttctgaccggacctaatatacggaccttttcaatggcgcctttcggaccgcatatggtgactgtttccttgcatgcatactgtcccggctgggataagtccttcattttggtcagctgataaccctggccgaaaaggatatccaagtcttcctgagacagatgcacatggcggttggaaacgccgactggtattcgaaactcatcggttccggattccgctttcacggcctccattaagagtttgattaccgcttcatacttatccattcctgttctcccttcctggttcatttactggcccttcatagccaatacgatctcctttacaagagcagccagcttctcattgtcatcgcagcttccctgaacagatgcagccggagaactttctttcttaccgaaggaagctacaaaatcggcaggacttaaggatgcgccctgggatttttccttccatgtaaaggtaggatcctcttctgcaatggtggaacaatcctttaagccaaaagctacctttttcacattgaggagatgctttggacttacgttttcagaaacagagcttccgccgcaggttccgcagcctaatgtaaaagaaataggaaggcctgtgctgattccggttccgccctggcttcctcctgtgttcacaaggatcctggaagcaggctttgcagcaaatttaagaaccatatccctgtcctgggtatgaatgctcatggtatgtccgatcccgttctgtaaaaggcggatgcttaagccgcaggcttcttcccagttctttacggtataaaaaccaaggacagttgtcagcttttcgtaggataatggatatccttctccaacgccttcctgcttgccgatgaggaccctggtcccttccgggatctggatgcctgctgcctgtgcaatcacctggggagagcggccgacaaatttggcattcatgttatggccgttcttaaataacagatcgcagactttgtctgtttcttcctttgacataaagtaacccccctggctttttaactccgcaaccacttctgaatggttgctttcctcgcagatgatggactgctcggaagcacagatggtaccgtagtcaaaggtcttgcttgcaagaattgtctttaccgcctgcttcacatcagctgttttttctatgtaagccggggagttacctgcacctacgccaatggccggctttcctgcactgtatgcagccttcaccataccagggccgccggttgcaatgataacggaaacttccttgcacttcatcagctcgttggtagagcccatggatggcatggatacacagccgatgatccctccggtgcgcctgctgccattgcggcatcacgcatgacctctgcagcctttaaagtgcatttcgcagcagacggatggggagaaaatacaatggcgtttccggatttaatggcaatcatggatttaaaaaatacggtggaggtggggttggtggagggaacgattcccataacaagtccgaccggctctgccacatcaatggttttattcaccgtatcctcctcaaggatccctcttgtcttcatatccttgatttcttcatataaaagagtggaggcggcatgatttttatatgccttgtcaatgacctttccgaaaccggtctcttgggcagccatttccgccagacaaagagcgtgttcctctcctgcctttgccatactcttaagaatggtgtcaatctgttctgccgtatatccggcaatttttttagcggctgcttcaccgcatcttgctaagtcccttgcttcctgaatggaacgcaaatcataatcaaaattttccatgttcccgttctcctttctacgagacgaaacacgctccgcgagtttcgctcgttgtcgcggctgctacattaattattctgtccataatacttcccgaattcttccagcagcagggttttatttgcctttgaaatttcccgtccggctatggtaaactccggatattcacgggcaagggttctaagctctgttaccttcatatcttcaagtatcttcatcgtttcttccagaccatcctgcttcatccataggtccatggtttcccgcttgatggtatccaccgtttccggttcattgaaaggctccaaagacggttcttctttgatttccggaaccaatgccttgtccggttcatccggagttcctccgccgactacagccgtcagctcatcatgaggcctggcaatcacatggcgtgttactagagcagcgctgtttatgcgttctaccgctgctgcaccggcgtccaccgctgcctttactgccgccacatcgccggtcaccgtaacagctacgagacctccgccgactttggtcttttccagaagagacacgtccgccgcttttaacatggcatctgccgcctcaatggctgtcagcacgccttttgtttctataaagccaagtgcctgcattgtttacctccttaaaccaagtcagcccagttcgccggatacgttgcgtaaaatactctcgccttgtccggagaaccccagattactttggaacctgatggtacgaagagcacatcaccggcttttgccgtgtagatctttccgtcaatggtaacggttaaggttccttcaattacataatcgatctcctcataggtcaattcccattcaaagctggaatgatcgatcacaaggaaacctgcactgatatgggactcatccttgcttaccagttcttgatagtaagccttaacagatggatcacccgtatcaaatacgtccatttttacagaacttccgcggactactttaagaccgtttccatggttttctgactcatagggctttaaaatgtcatttaacaggcccttttccattaaagtcttcagtaccatataaattttatcgctgtccatatcaaatcctgcaaaagccgccggggccggagccagtgtctgctcctctgccttatcacagaatttgatgccaaaggcatcagctgcatcctttgcagacggagtgatgatgcttccgctttccatgtaaaataccttttttccctcagcgtttaacttttctacatcctttgcacaaatcaactgcttcatatgatcacttcccttctatataaattggcaatcctcatcaatgatcccgatcactacggcatctacgggaacctcatcgcttcccagcatccgtctggcagaagatccggtggaaacgatcacacggtcaccgattcccgcgctgataatatccgctacgatcagccgttccccttcccgtgtgcctccaatgatctcggcgagcataaatttatatccgtttaaggactccgcttttctggttgcccatatgttatcaatcagtcttgccgctaccattcttccacccctctcttttctctttgtttaatttcgtccaaggctgcctctaccgatgccgtatctccaaaaatcgccagcatgatcatgttctgggggcagcttcctctgatgtcttctaccgtaacacctactgccttttctgccacatcagcagcacaaaccatttcaatgatcctgccctgtatcagtcctactgcgtccaccggtcctatgggggatgaggtaccggagcccttcctgcggtttaagatatcaatggttccctgtgacggtgatttaattatacggtattccatattgtccacatcctttatgccagctcttcccgggtgcaggaaaatgcgattccaagaggagtcacaaacattgggttctcaggtttccgtgtcctgattcccgtctgtttttcaatgattgcctcgattccggtaaggcagcaggtaccgcctaccagatagatttcctgtacatcatgtcctttaatatggcggcttatgatggaagccaccttctccacaaccggttttaaaaccggaagcagttctttatggttttcttctttccgcttataaacttctgcttcctgaaagggcatttggtaagcaccggagatcaccagggagaaatgagtccctcctgttggttcatctgctacatacaccacttttccatcctttagaatggaaattccggtggtgcctcctccgatatcaacgactgcgccgttctttatttttaaaactgcgtttgctgccgtaggctcatccagaagagccgtgatctcaaatccagctccctggaccacgttcttgatggctcctccgtctaaggagtcggtaccaggaggaatggctgcagctgcaaaatacagttccgttcccagcttttcctccagctcttccttcagctcccgtacgattcttatggcaccgatataatccactaccattccatcccggaccacatctgcataccggtaagcgcctgcaacaggtttgtaattctcatctaaaacagccagcaccacacacgccgttcccagatcaactccggtatagtaaacagaggagccacccattacgggctgcttaacaactgcctcgaaccggctcaccagttcattgcagccatcaaatgttatatcttcctttgacatgtttttcctccatattccagacatatcatctgcgataagcggttaataaccgggtttaagttttcgctccctgcttcagccgccagctctcttgtgctgcagcgcaggcggtgcagaagaaggatttctttccctttttctgactgtgcatgaaaacctgttatttcaaagcaatcctcaaagggttcctgtaagttatcctcatgaaatccggtgcagggtttaaatccggtttcctcttcccggccctcttttttaaggttggaaagttttcgttccagatcaaatacctgttctgccagaagaacgtcccggcctaacagttcaaggcccacttccaaaaactgtgcctgaagcgttttcttccttaacacgaaatgatccttgcagatttctttttccggtgctgcttcctttttctccgcaggttttatacttttctgttttgccatcatggggtcatctgttatggaaatcttcttatccaccagaaactggcgggctccgggtgtcagtctggttcccacagggaggtcataggcggtaaagggttcttttctgaataaaatccttaaatcatcttccgtgatgaatttcatcaatagccccccttacacagtttccggtaaatggcttcaatttcttctgccacaggcactcttgggttggtcaatgtacaattgtcagccagagctttttccgccatatcccctacggcctgctcaaattcgtctttatcaacttttaaatccgtaatctgctgaggtattttgatcttattcatcagatttttgatgtggcgcaccaggccgtgtaccgtggccttatctgttccggctgcgattccaagcatattggcgattgccacatacctgccgcaggctttctgttcacctgcgtcttccagtccggcattgtagctgatgacatggggaagcaggatggcattgcttcttccgtgaggaatgtgaaaccgtgctccaagagcatgggccatgctgtggcaaagccctaaggaagctccgttaaaagcaactccggccagacaggatgcattgtgcatgtgagttctggcttccatgtcgcttccgtcctctacggtacgtgccaggtagttccataccagccttacagccttttctgcgcaggcatcggtaaaatcacctgcattggttgaaacataagcttccagggcatgagtcagaacatccattccggtatccgccgtaatatgaggcggaacagacaccgtaaaccggggatcaaggaatgccgcatccggcaccatgctgtcggagcgcagcggatatttggcctgggcctggggatcagagatcacggaaaaactggtcacttcactgccggtaccactggttgtgggaactgcgatcaaaaacagcttcccatttcccatctggctgtaaatatggcttgctgccttggcagtatcaatggcagaaccgccgccaaaggcgatcactgcatccggaccaaaacacttcattccgccgatggcctttgagaccacttcaatggtaggatccggcactacttcggaaaacacttcatagctgctccctttttccttcaaaagctctgtgatcatgtccaccttgccgcattgggccataaaggggtcacagataatataagcctttgtcacaggaagttccttcatcttatccagacaggaagatcccatatatacctttgtattcattacaaattgctccacgttacatttccctcctttcctcttatttgcccatgtattttgggcattcaggtatacccgcagggtgtttcctcttatttgcccatagggcatttccttttattttaattcttccaataattcaagaagtccggtcccttcagacagattgatatggtaatagggctcctttgccccggtttttttcagctgacggatacaccagccatcattttccgttttttctccgtctcctgtaatcacgccgatcaccgggacccggaaggcttttgcaaatccaggcggataactttcccggcatgatgactggtctaccagcatcaacacatgagaggcatcctgtgccgccgctatgatatgcttgtgcatccagggactttccaagtaaacccccggcacatccagagtttttttcccatataccatgttctgggttttcctggccggaccggtgagaccgtttataacgttggccagggaagttttcccgctgccgccgggaccgatgatcatgatccgcttttttctcatgtttttgttaccgcgggcaccatataacctagcccccgctttaaggtatcacataccgcagtcaaagcagtttccacgctgtccacatctcctgcaatgattacagagcctgtaaaacggtctaaaaagccgatttccacgtctgccgcctttgccgcaatatccgccgcaatgatggaggtttcaaaaggggacagggtgagaattccgatggctcccatttcatcgatgccaaggcattcatacacctccggtatgggagatgcgatcacatgggctatggtcacctgcttgcccggaacggattcctctatgacacgctgcatctcaatcatggcctcttcccctttcttaatgcttcaccacagtgaccgggaaccggtattcctttatccacccttcgatccggtctaaatcctccatgcttaagcttggatcaccttcaatggggtattccatatcaagctgattgtatttattaactcccagcttatggtatggaagtaagtcaattcccttaaaatttttataatcacggaagggcatcaggaatttaattaccccgtcgatttcctcccggctgtcattgattcccttcagcatgggcatgcggacctttacgttgaaacggcggtgaagcagttcctttaagttggtaagaatctgttcattgttcacgcccaccagctcattgtggcggacagggtccatatgcttgatatcaaacaggaataagtccacatactccgcgattcttaaaatggtttccgtacttgtataaccgcaggtctcaatggctgtattgatcccttcctgcttgcaggccattaacaggtttaaagccgcttccggctgggcggtcacttctccgccgccaagtgtcacgccgccgcctgaaatatcataaaaggcagcatcctcttccacgattttaagcagttctgaaatggtcttaacttctccggcaatggtcagcgctgcattgggacaggcatttttgcatttcatgcaaccgatgcagtccttttcccgctggatttcatgttttcccgtctctttggacattacatggattcctacggggcacacatcagcgcacgccccgcagcttacacaggaattttgcttatacatcacctggaatttccgcaccattccttctggattggagcaccatttacaccggaggggacagcctttaaagaataccagggttctgattcccggcccgtcatacatgttgtatttctgcacgttaaagataaacgctttacgctcaatctctcctgttgttccatggtccattgtgattgttctccgttttcttttagaaatgtgtcagcatggttctgcttatgatctcatcctgtacatccttgcatagctctacaaagaatgcgctgtagccggctacgcggacgattaagtcacggtacagctccggagctttttgagccttaactaaggtatcgttgtccagatagttaaactgcatctcaccgtttccgaacatgcaggccgtacgaaggagggtgatcaggctttcttccccttccggagtatctaaaagtcctgccatgatcttaaagttatgaaccataccgatgttcatgctgtcattggacatcttggatacggacttgatgattgcggtgggtcccttgaaatctgcaccctgggtcgggctgattccatcggaaagaggcagccatgcgttacggccgttggcagaagcgcctgtcatctgtccgaatggggtgttattggaaatggataaggtaccatggcttaaaacagaatataacgtcttatatttcctgtgttcatgctctgtaaagtcaaccaggtcagcagcaattaaatctgcataatcatcatcatttccgtatttcggagcattaaggcaatcggtacggatctggtcatatcccacaaaatcagcctttaaagcctggtttaactgctccagtgtatactttttctcttcaaatacaagcttcttgatggctgccatggaatctgcataagtagcaagtccggaccataccacaccaggcccgaagttatacatggcgccgcctgcggatacatccctggccttttccatacagccttcatacatgatggacatgagtggctttggagctaagtccctgtgaactctctgggaaattacggtggcaacatcggtccactttgtaatgtatttaatttcttcttttacggcagcttcaaactcttcataagttttgaaattgcttaagtcacccatatccgggcaaacctgcttgccataccataaaggagcgccgtggtttaaaacaagctcaatgcagatgggccactgggtataggcagtggaggtccactgatacagacggccggacttctgaggctctacgcagcccatgaggcagtaatcacgtgcatcttcaatggatacgccttttgcaagcatcatcttgatgtgggcatcgtcaaaatggcatgcagggaatcccataccggaacgaaccacatccacgatctttttcatgtactttttcggggacttgttgtggatacggcatgcaagagacggctggtaaatctttacatgacgtactgcatccataagtaagtaagttaaatcattggtggcatcgtgtccgctgcgggtcacgccgcctacacacatgtttacaaagggctggtatcctgcaaagaatttggaaccgccttcgctggtgatccacatcatctcagacattttgatcagcatacagcctgcaagctcaaatgcctggaaatcattcatacgtccggattcgatatcatctttgtagaatggatacatatactggtccacacgtccgatggacataccggtctggttttcttctactacgagcagggattcaatggtccatacggcctggatcgcttcccagaaggttctgggcttgtgtgcaggaacgtaagcatttacttcagagatctttaacagctcttccttacgctttggattggtttcctttgctgcaagctcagctgcatactcagaaagtctttttgcatagatcataacgccttctgtggtatcgataatggatttgtagaaataaatcttctcaatatcatcaggattctcataatccagttcctttaaatgatccttggcttcctgctgaatgtccagcatgcccttcttcataagaatcacatcatagcccgggttggagtcaccgccgccgttgatggcatggtaggagcagtcagatacaaaggattcccctgataattcccatacccctgcttcacggtactgatcctcacaatactcatcaaccgatttgccggaccagtatgggaacagctcttctttcatgattttcttgtcttcttcagaaatatagaagggatcctgaggacgtgtgccgatggtatcgatctcatctaccatccatctccatgcgatatccggggagaatgcacctgcacggggagcgccgcagggagcacctacgataagctcattatcctgaatgaccaggggcgcagtctcacagcagtaacggaagcattttgcacgaagcatgatctttggcatgccgggattttcttttgcaatcttggtaatggcccgcgcacggtaggttgtaatagatggcttatgtgttaagtaattatcttttaatttctgaagtcttgaagtaatcccttccggtacctctgtacctccctcacagcatgctgctgcctgagatgaaggttcttttttgttgatttcatcagaaacagtttcaaacattttcatcagggaagctctttcttccggtgtcatgttcttcgttgcttccacaaatttatttgaaaattcacgaatatccaatctgatttccctctctttcaattatttaccacctaatgaatcaagcggatttgcttgcatatccagttgattcacaaattcaaggttgaaagacgcttttctttcaacatttatcatccagctcttttgacaaggcttccaaaatctgcttaaggagctcttttgcatcttcacagtttccctttgtcttaagagctttctcatatccgcctgaagctttctctgccgtcccaaggaactccctggctccccggacgccatatcccacactccgtatgtaaatgaagttcataggtgagacgttgtcagccgtgattccggcgccggccgtaatgcttcctaaggtcatggcaggaaacaggttggtggtggctcccatgctgcccaaagtggcgggagtattgacaagaactctgcccaccggcttctttaaggcgaactggcgtattacttcctcatccctggaatggatcaccagggtatgtccatggctttcatttacaagaaggctcatgcatttttcacaggcgtgcatccagtcattttcgatgtaataagccaatacaggacacaaaagctcttttgcaaagggattcttctcagaaatatacttctgctcagaaaccagcactgttgtggtcttaagcactgtaaatcctgccctgtccgcaagctctgccgcaggccttcccataatttccgtatccggcttcccgctttccaggcagaggagttcaatcagctttttctcctcttcctcattcatgaagtgagctccgttctttatcatttcagcctttacctctgcggcaataaggctgtctaccaccatatactgctcggccgcagacacgatgccgtaatcaaaggtgcggctggcaatgatatcctctactgcctgtcttacatcggcagtccgttccacaaagaccggtccgtttcccgtaccgccgtaaatataaggctttccgctttctgctgcctcccggcaaagctcaggaactccggtgttgaccaccatggctgctgccgggtgacggatcagctccagggctcccgcccttgtcactgtctttaaatacccgatggctccttccggaagtccgcaggatattcctgcttccatgagccggtcaaggagtctgccggttaccttacttgccctttcatgaggagcgatcacaatgggattgcccgacttaacggctgtcagtacgttgtaaatcgccgtagaaaccggactcactgccggtgtcagggcagcaatcacgcccacaggaacgcctactttcatagtttttgaccgggagtcttcttccaggatgccgacgcacctcatatcctttaagcgctccggaagaaaattgcagacaaaggtatttttcacgtacttatcctggtaacgtccatatccggtttcttctgcggacatgaccgccagttcctctgccagttcctttgctgccgccgcaagggtgccggtaatgagatcaagcttttcctgaggaaaggtaagcatggtctttctggcttcccgtgcaccttccattaaaatccttgcctcctgtatggagagcaagtctttatctacaaaactcatttcctattctcccttcatccgggatgcctgctattcctgtaccggagcagttattaaggcatatcgtctgataattttttcaaggtggggatgaggtcttggaatcacgattgagctgtaaacttccgctcccatatcctttaccgccttgataccggcttccacagccgttttgcaggctcctacgtctccccgtaccagaacagaaatataaccggaagctacattttcataacccaccagttccacatctgccgccttgcacattgcatcagccgcttcgagaacaaataccagaccaaatgtttctatcgcacctatggcttcatatctttccatatcctgttttcctttctctatgcgtcaatatcgtgcacggacacaatgtctccgacctctttgatcggccttggcatcacgttttttgcagtcatcttgccgatggctgccgccgcttctgcacctgcatctacagaggagcgtactgctgccacatcaccctttaccatgatggtcaccagggtggaacctacgttttcataggaaatcaattctacatccgctgccttaagcattttgtctgcagcttccagtgccggaaccagtccgacagtctctacaagccctaacgcttcatctccgtaatatctcacctttgtaaacctcctctttttatttgcggtatttcttatccacgtatttgtcaaccgcgcttcttccgtcatcgttaatttcataacacatacgcagttctccgttctgatccagatcatagccgcataagctgaccatgccatttgcctctaaagacatgacatgatccagataacgatccttggtaaactggcgttctccgccgtaaagaggttttaatgcctccatgatctggccgatatccgcattttttaccccatacaaataatttaaaactgctgttcttgcaggtaataacatttctttattcccctttcctgaataaatccagcggattcatggttaccagaatcgcaccgaacacgattacaatagagccgattacaatcgtaggggtcactgcctgtcctaaaaacaggatacagaagaaaactccccagaacgcataggttacatttaaggacattcccacggcacagccgacagtggagttgctcttataccagcagaggaatgacactgcggcacttaagccggatactgcaagccagattgccggaattcctgcaaaaagtgttccgcccagaagtcccattcctccaacgataggcaggatcacgaataaatccacaacaccggaaatcagctggcgtaagttaactgccacatcagtgtcaatcatggcgccgccgtaagtggcaaatacgccttctaaagcccagcagattgccgcaataaaggagaatataattcccagtgtaaagttgtcactgccttccggctttgtccagttgatgatgatggcaccggctacgcataccagcatacccagcataactctcttggtaattttctgttttaggaagatccatgcaaaaatggctccgaacaagctgcataatgcggaaatcggaatcgcataggcaccggccattgcaaggcctaccagatacgcgccatttgctatgggaccgccaagaagggatccgatgacgatcattttaccagggaatgtatgaagacttcttcccatctcacggatacggccgctttttgcattataaacagtcagccaaattcctgcgaaaagatcgtttaagccggagcacacatatggtcctgccaaaagtcctgccgcactgacaaggggttcataatatccggccaccagcacaagtacggtatagattccgtatgtaagtccggataatgcaccggttgtcattccggtcgtcctgaattttttgttaactgctgccatttgtgcatccgcggatgcagatgtcattccttggttactcattatttattctccttcttgtcttttggaagaatgatttcaacctctgcgtgaggacgagggattacatgaacggaaaccagttctccaactctctgggcagctgccgcgcctgcatcggtagctgcctttacagcacctacatcgcctcttaccataacggtaacaagaccgccgcctacaaattcttttcctaccagagttacgtttgctgccttcaccattgcatctgcagcttcaatagaaccgatcaggccctttgtttcgatcattcctaatgcatcaaatttcattgcttacttcctcctttttcatgagcagttcaaatgggtccacggatactaaaaccgcgcccagaatgataataatggaaccaatgattatggtcggggtcacaggctgttttaaaaacaggatacaaaacagcacaccccagaatgcgtaggtaatattcagtgacattcccatggcacagccaaccgtgctgttggatttataccagcacaaataggatactgcggcacaaaatccggcgatcaccagccacaaaaccggtggcagggaaaaaagagtgccttttaaaagtcccattcctcctgcaatcggcaaaataacaaacagatccacaatacctgataaaagctggcggatgttgatcaccacatcagtatccagcatggcacttccgtaagccgcgaacacgccttccaaagcccagcctatggccgcaacaaaggcgcagatgattccaagggtaaaattcgtgcttccttccggctttacccagttaatgactatggctcccaccacacagatcaccattccaatgccgactctgggaacgattttctgttttaagaaaatccttgcaaacaacgctccaaagagaatgtacatggcggagattggtatggcataggctcctgccatggccagtcccatcagataggcaccgcttgctatggggccgcctaccagagagccgatcaggataatttttcccgtgaacaggcttatgcttcttccgatctcccggatccttccggtctttacgttataagcggtcagccagagacctgcaaataaatcattcaggcctgaggttacatagggagcagcaaacaatcccactgccccggcaagcggcttgtaataacctgcgatcaaaacgaatgtggtatataacccatacataagtccggataccaagcctgttgatatgccaattgctttaaatttttttcgtgcttctgtcatctaagttttccttccccatttgaatactgcacaaaattcatgttagcctgtttctctgcttttttctttacgttcagctgaaaacgttagaaaacacatcacgccagttaatgttactaattttacggaatcgctttgtgtttttctatgcatttagtatagatcttccccctatggggaatgtcaaccggtttttaaacttttttatgctccaaatattgggagcagctgccacctccggaaaaacaaaagggctcccccggttcagcgtccttttaaaacgccgtatccggggaagccagccgattccatatgctcccttaatctctgtatatgggaacaattacttctgaaacaaattcagccggatctctggtggtccagtaatccaccacataccgttcaaagctttctttcccacatttataacctcgtttagccgcccagttaagtattttctcatactcttcatcaattgattcatgcttaccgatatgataaaccgatgcagccataaatcctccaaaagtctgcctgtttaaacagtccttgcatggatgaattgcctgctgcatgatcctggcgcggctgcacctgcctgccatcttttcttcaaatgattcgaattttaaaattaccggccctgtaatttcattctcagccgattctaagtgattggtccactctatgttaataatggattccatgtaattgtagccaaagtcctgctccataccgcagtaggtcaccggctgtatatactttacggaaacttcattcacatcattttggagcaccagcttggcttcctgtatcagctcataccagtccttaaccgcaatatagctgttatggatctgctgctcctgaaggcatagctggtcaatcttattgcggaaattctgttccagataataataagtattgccttccaccagcccttccatctcttccagcttaaatcccatttgtttgtagtattttaccaccggaacagtcagaagcgtctctttgttataataccgatagctgttttccttgcagatcatatcaggggatatgatcccgattttatcataaaatctcaaggcttttgtagatatgttgcagatcttactgacttccccaattgaatacagttttttttcttccattgaaacccccataagcatatgctttgtctaagtgttcattgttcattaccgttttatttatgagtcttcttgtactgattaacttagtataatccttcctgtataggggaatgtcaacaactacttatgtaatctatattatacgaaaatgattgcatcggaaagcagtaaaaatctggaacaaggagtatgcagccacggcggagtgcattttatgaataaaaaagaccaccggcctttccgattatccggatgacccgtggtctgctcctgcctttttatcttaacttctcaatcatttccaatacttctttcttggatttcactccaacagaagtggctgctgcctttccatccttaaaaatcacaagagtaggaatgctcataaccctaaactgccctgccagatccggctgctggtctacgtccacctttccaacctttacgtcaggaatatttccttctgcaatttcgtcgattacaggtgcaaacatcttacatgggccgcaccaggtcgcccagaaatccaccagcgcaatgccgctgctctttaccacttctgtttcaaaattctcctgtgtcaatgttaatactgccatatcatgttcctccttcttaacctgctctttgtgtattcacaaacagcaccatttattcattattcacagcattcccctgtttccaggaaatgccgctgcgtcatatcatgaacagttcatcctctgcaatgatccccagctgcggtcctcttttatagttttatcattattgccttaaatatccccgttttttgaatcattgcctataggataactgtaactttgtaagtttcagtacctttactgttattataaaagttacagttgtatttgtcaatagatttttttatttacttataaaagtcaaggcccagctgtccggttcttctaaggaactcatccttgacctcctgcagtccctcaccggctgattctcccccggtaccggacagtttcccgtattccaatacctcagaagaaattttaccgccttcataacctccgcttaactccagtccaagccggaatcttccattataatatgtgatgtttagttccggtatctggaaagacctcttcccttcctcgccattgccgaaataaacccttgtgctcacacttagctcccgctcatgaagcgtgatctttccttccatccacagcccttcatgagactccagtaaaaggctcatatcagccaggccctccacccggacccgggttatatgtaactgtttatcaatggtaaataaaatttcctgtgcttctccctgggttttccgctctttcagcatccggccccattccttcatatctttaccagggccgtcttccagcagttctcccatttcgcttatataagcatcaaacagatcggaagagaccaatgccttaatggtcacgccattcttatcccttcccataaattctatacggctgcagttcatcatttggatggtatctttttttaaggtttccagccggtcctttcgctgtttcctctcttccgggacaatggaaaatcccacaaccttttttaatgcttcctggctggtccttacggatgtcctggtaatccccggaacggtgagcacggcattttccctgtcagcccaataatggaccccatcccttatggcccccagaaaatacacgtcaaggcttccctgggcaaaggtattttcctcatccctttgctccttccaggagattccaaatcctcccggaagcaccagcaccgaatggccattccataccacttcatcagccaccagctttaaagaatcctcgtcagccccttctcccttgggatccctgccccataagcccataagacgtcctctggtctgcagcaccgaccgtgtcagatagaacctggcataatactcaggaaggcagcgccatgctaaagctccaaacacaaggaaaagcaggatccccgcaccaatacacccaagccagcctctgattcccaggggtctttttttctgtccggccttacataattcctgtctggctgagtttttcttcaaaaaattcattcagctttaacaccttcttccgcaatacgatcccaatcagcaatgatatgggaatatagaccagcacgttttggaggtctttccaataggcaccctcataaattcctcccacgcactccctcatggcattgatgagatgagtaaagggaagcagaggattgataatctggaaaaaccggggagtcacctgtatggggaaggtgccgccggagcctgccacctgaatgaccataaagaccaccacaatcgcttttcccacatctccaaaggagaccgtcatggaataaatgatattggtgaatatgatgcttgcgatcacggctgccagcacaaatttccctggataaaggcactggatcttcagcatatacaaatctcccagggccaccaccagcgcctgggcaattccaaacagcatgaaggtaagataccttccaaaataagtctcatacagcttaagtccctgcgacctgctctcttccaccctgcattttaccagtgcgactaaaataagccctcccacccaaatggccaggaccgtataaaagggagccatggcagaaccataattctctaccggataaatcttattggtaaccatatccgcaggcatcatcagaaagtcactgagctgctccgggtcattcttcataatgtccatgatcttattcagctgcttgttatctgccagcttgtttacaccgtcgatcatatcatccacccgtttctggctcctgttcatcaggctgacagcgctgtccaaagcctggatcaggctctgggaggaggcagtcacgctgttcagggtggtatcgatctctcccaccatgcttccgatactgtccaatgctcctgcagtggttcccagagcatcatagctcttatcaaggctgtcttttaagggaatctccaccttgccgttataaaaatcaagaatatctgatatggaattgtaaaccgtatcaagagaatctccaatatcttttttcatggtatcgggcagcctttttgtctgttttacagtctgctgggcggtctgaagctttttgaccagatcctgctgctgtttcacggtatctgtcagctgctgctgaagggccgttatctcttttaaaggaatgggaagcttctggttaatctctcctaaaatcctgtttatgctattgcactggctgatgcttcctgccaccagattttccatggctttcaatgcatccaaagccccgtctgcagaggtatccgtaagcctgccgatcacctggaaggattcgtacactgattcttctatctgcatgatctgatccagagtatccttaagccctccggtcattgtatcggaaaagcctctggaggagtcgatgagggtttttgcgctttcagccgtttttccgcctgagccgatcattttactcacatccggaagagttccctttataccgtcatttaagctgttcaccgtgcgaagggtggactgcagcatggtgatggtatccacaagctgattcaaatcttcctttacctctgtaagagagctgaccgcatcgtttctgtctgtttccttatcaatgctccagtcgtctgaatatttgttcaggagctttccaaccacctttgaggtggaattgataaatgtctcattgatctgctgctgtacgctttccactcctttgccggtgatctttgtggcaatggcatttttcttctcatttacataatactgaagcaccgggcgttcaatgtgagaggtgagaacgctggaaattttccggctgaaatcttccggaacgaccacagcagcataatatttccctgattccactccatcgatggcctcttccctgctgacaaactgccagccgatctgttcattctttctaagctcatccaggatcatttcaccgatattaatagaagaatcatcaatatccgtgtcaaatatattgtcaatggaggccccttcatcctggttcacaaccgcaaccttaagaccttttgtattggcataagggtcccagcttgcagcgatgttaaaccatgcatataaggccggaatcagcataagtcccagcgagatgataattgcaaccggattaagtgcaatgcgctttaaatccccggcaaaaatttttattatgttcttaacatgtatcatgtgtgcctccttggtatgtgggctatgaaattttgcatttccgtattataatattttcccgcaccaaatgcaatgcctgattcccaatattttacaaatggagaaaaaaagctgttaagtgattctttgcatcagaatgcatacggtcacttaacagcttgccacatttagaaacaaaaatattttttcagggcgttccagcctgcatacccatcttaagctcttccacaatggaaacacccgcagtagacccgatccggctgaccccaaggtctatcatctttaaagcagtatctaaggtccttacgcctcctgccgccttaatcttaatttcatcccctaccatgcgcttcatcagagccacgtcttcaaaggaagccccggccgttccaaaaccggtggaggtcttgatgaaatcagggcgcacattcagggcgatcctgcacaattcttctttctcctgatctgtcaaatagcagttttcaaaaatcacctttgatatcactttgttttttctgcacacttctgtgatctctgccatttccttttcaataaaaccgtaattcctttccttaagctccgtaatattgatcacgtaatcgatctcatcggagccgtttaaaatggcggtctttgtttcatttaccttatcttctatggtcgtctggcccaaaggaaacccaatggcagcgcccacatggacagggctgccttttagcagcttccggcagcggaccacctgagccgggttgatggctaccattttaaaaccatattccatgctttccttacaaagctttacaaaatcctcatgagaggcccaggctctcagctgggtgtggtcaaaataagaggccagctcctttggactgatctgaatcttccccataaatcgcctcctttacagctttaatcatcgtcatcctgattctcataattttccgtcttacatgcggcagtatccttcatcttctttaacagaggatgctgtttccatctgtttaaggctgtggtggcctgataggcaaggatctggaaaaacggaagaaagcacagcggggtcaataattccggaagctcaaaagaaagatttaagatcccttctccggtgcatccaggctgattggttattaaaaatgccctgtcggtcacctctctgcatgctttaaaaatggtctggatccggctgctgctgtttcctccgtcaatgagaaataccgtataaccagggtcatctgaagattgggtccatgaaggaattcctccgattcataagcagtggaagggatttttacggtttcacccagctttaaagctccttctaaagccgtgccgtaattggcgccgcatccgcagacatatgcgtttgtcatggaagtgaattctttataatgatcttcgaagaatttcatggtttccttttgaactgtctcatggatttgtgccgccttttccatatcccggcatactgcctctgcttcttcctccttcatcaaaccttttcttacagcagcctcaagggtaaacagcatcagaaacagtgcaaaggaggtcacaccctttgtcacatatcctacggtctccacccccactccataatcgatcagcacatccgcataatccttcatatcactggagatacttcccgtaattcctatggaagcacgtccctgctcacggatcatctttaaggcatcaatggaattggtgctgtatccgctttgagatactacaaaaacaaaatccttgtcactaaaatcgtgttcgctgcaaagaaaggtaaagggagatacgatctttacttccgactttaaatactttctcataaactggcgggcgcagtaggagccattataggaggagccggaagctacgatccagatgctttcgtaatcccctttttcatattctgcaagcagcggggctgtcagctctttccggtttttcacatttttaagtattacctcaggggactcttccacatacgtcatcattgtttctttcatagtttcattcattttgttaccgctcctttttttatttagtaaaaatgagaccaaacgcgttttgtgcaataattatatcatatccttaagtatagtcaataatgtattaaaaacatacaaatatttgtaattacatattgacaaactttacccatgagactatgatttgtttatacattgtttatactttttttataaaaaggagtggaaaaataaaaaagagcacaaaataccagaggggatacaaaatttaaaaaggagtgacaaacatatgcccaacattctattaacaagaatcgacaacaggctggtacatggtcaggtgggatgctcctgggtgggagccatcggctgtaacctgatcgttgtggcggacgacgaagctgcaggtgacccggtccagcaatctctgatgaaaatgaccgcggattctaccggagtagggatccggttcttcacccttcaaaaaaccattgaagtcattcataaagcagcaccaagccagaaaatatttattgtggtgcgaaatccccaggctgccagagtcttaatcgagggcggggttcccattgataagctctgcatcggcaacatgcatgtggctcccggaaaaaaggtgtcaaatgaacctcatgtgtatctgggagaacaggacttagaggacttgaggatgattcgtggaaaggggattgatgtgtatatccagatcgctcccggggataaaaagcatgattttgaggtaaagtaaacacatttgttcatggaaattgagaaggaaaaatatgggcaatcatgatgaaaaccgcaggaaccacctgcggttcaataataaaaggagggtttaatatgcaaatcactttaatccaggggattttgctggctttactggcttttatctgtgcctgtgatgcctgctgggaagcctttttctggttccgtcccattgttgtcgccttcttcgccggaatcatcctgggcgatgtgcaggtcggcttagccgccggtgccgttgcagagctttcttatcttggtctgcttaccgtaggcggcacggtcccccctgatccgcttatggcaggcatgatgacaacggtcatcgcattcactaccggccagagcgcggaaacagctctgggactctcgctgccctttgcattgctggcacaatgggtcggaattgtctgcaataccactttcgcaggctttttacgtcccttgaccgtgcatgtgagaacgcagacacaaagaaatttacacagatcgttattcttggaattgtaattaaggcaggcatctatgccctgatcacattcctttccgcttttgcattgcagaaccagatctcaggatttgtaaacatgttcccggaatggctgatccacggctttgaaatatccggcggcctgctccctgcagtcggtcttaccctgttgcttgttgtcatgcttaaaaagcagaacgtggcttatctttttattggctttttaatgatgacattcttacagcttggcaatatccttccggtagctatcgcaggaatcgccgtagcattcattggctatctcaatgatgaaaacatcaaaaagaacgccgtaactgtaggaggtgctgacgatgacggtatctagagataaattgacaaaaaaagatatcaaccggatgagcctgctttccatattggaacagtcctgcttcagctttgagcgcatgcaggccccaggcttctgccttggtttgcttcccggattaaagaagatttacggcagccagaaggaagaaatcgcggatgccatgaaaaacaacatggactttattaacactgagccacatatggccaccttccttcagggacttgtcctttcctggaagagaacggacaggacagagcactgatcaagaatattaaaaccggcttgttcggtcctctggcaggattgggagacgcgatcttctggtttaccctgctccccatatcagcggcgatctgctgttcccttgccagcggcggttcggtacttggtcccatcctttatattgccatctggtttataggagccatatcaagactgtggttcggccgcatgggatataacatgggtgtgggagccgttgacttaatcagctccaatgccagcgccatcacaaaggcagcgggcatcctgggcatgatggtggtaggcggtctgatcccaagttacgtatccctgcattttgcagaaacgctggtagctcccggcggtgtttccatacaggcgatatttgattccatcatgccgaacatactgccacttgggtttgtattcgctctttactggctgtttaagaaaaaacatgttaatacgctgatgctgattattttcattatccttgtatcagtcgtattgtctttctttaaaatcatgtaactcacggaaggaatcctatcgaattctgccgggggccgtacaggaagatctggaagaatttacctatctcctgtatggcccttgtgcgtgtgaaattgcagggagccttatcacatctggataggagccggggatgccttcctgaccgcctttctcttaagcctcgcaggccagggctggaaaaagggctgccagatgacggaacagtccttaaaaaaggccctggaaaacggcgcccgctacgtggcagaaaactgcatgttaaaaggcggcctctgacgccgttttaagcaccgcggacatcaatcgcgatatccgtcaaaataacgttgcagggaaaattccccaatggtatactgtacagacgggatctccctgttatggaggtgtatacatgaagtttgaatttatacaaattgataaatatagtccggttccattgtacgaacagctaaaggcctgtctgatcaaggctatccggaacggaactctgactccggggcaaaaactgcccacagaagaggaaatatgcctcaaattcgccatttcccggcctgtggtccggcaggcttacggagagctggacaagcttggactgctggagaggaagcggggctccggaagctttgtgaagtccaatacggaccggggagtatttttgatgcagcttgtcagctacaatgaggagctggccatgatcggcatgaaagccggaaccgatttaaaaaagaaggaagtcgccccttatcatgctcagatttacgaaaaactccgtttggaaccccagcagcactgtcttcatctggaacggatgcgctatgcggacaaacgcccttttacctatattgaaaatttcgttcccttggatctgtttccgggaattgaaaatcatgattatgggacagaatccctgtatcatattatgaaggatgtatacggtatctatccggccagggcggtgcggtccatccgggcggaaatcatcgatcccgcacaggcacgcttatttcacattgaaaaaggctccccggtgcacatgctggaaagcaccgcttacgaccagtatgaccgtcccattgactacagcatagaaacttatcccggcaacacacaccgatttgactttgtggtttacagagaataaaaatgaatgaacgccccggaggcatactcatatgcccaaaagcgcgggtgggaaagaggagattatgactggaatcattattacaggccatggatcatttgcatacggcatttcaagcgcactggaacttctcacaggtcatcaggattttttaattccaatagattttaagggagagcacagtgaggaacagctgaaggaaaatttaaaggcagcctttgaacgtttcagggactgtgaacaaatccttgtgctatgcgatatccttggcggctccccatttaaaaatgcagtgcttttaagctttggagatgaacggatcaaggttctttacggaataaacctgggtatggcagtggaactggccatgcgctgtatgacggggcagataccggaaggagacaccctggccgatgaactcattgaagtcggaaaaacgcagatcggaaaataccggtatgaaccggtagaaacgtctgaggaagaatatgaggaaggaatttgaccaatgataaaagcagtgatatttgatatggatggagttttgattgacagtgaaatcgtgtacttagaccacatgcatgagaagctgaagctgaagtaccctgatatcagcagggatgcactgtttaccgttgtgggagccactacgaaaaggaccatggagattttaggcgaggtgatcggaaaggatacggattccctggaatttcaggaaatgtatgccggaatctgggccgattgccgcccggattattttgctatcctgcgtaaggaagtaccggagcttttaaaagagattcaccgcagaggttatctggtggctctcgcatcttctaccagcagggcagggattgaagaggttctaacgacctgcgggctgaagggtgactttgattatattataagcggcgaggaatttaaggaaagcaaacctaatccggaaatttatctccacacggctgaagccctccattgtgcgccggaggaatgcctggtggtagaggattccacctatggaatcatggctggacatggggcgggaatgactgtggcttctcttgttgatgaacggttccgttttgaccggagccttgcggattattccattcatagccttggggaggtgttggaggttctggaagggttggaaaagaagggatgatgtggattggattccgggcggaagggattcatgtggaaaagtacccggcatgtttgcttatagattgatctgaatcaaacattttttataatatccaccattagattgtgctaagcataggacctgttgaaaaataatgccttcaacaggtccttaattttatgtcactttattatttatgattttcatttaaaatgatcattctgcgaggtggcctgctgctatcactgaaaattaaccatctaaattaataaatctccacttggtatgatattacaggccacagcatatacattttaggattaataagatcattcggagggatcatggtcatacatgttgtacaacccggtgaaaccatcaattcaatatcagagtattataatatccccgtttacagattaatattggaaaacggaataacaaactctgacaatttagcaattggccaaaccattgtgattgttcaaccagaaatactatacaccgtccaaatcggcgatactttggaaagtatagcagagaagtacggtgtttcacccatggaattattaaggaataatccctatctttctgatagagattttttatactccggtgaaaccattgtgataaaataccagacaaacaagtcaagaacgattgccactagtggttataccttttcttatatagataaatccgttttaataaaaacgcttccttttttatcatatctgaccatattcaattacagagccacaagtgagggagaaattatctccattgataacgacgccgaactggttcagctggctaaagcttatggcgttgcacctatgatgtttgtttctacgattacggaagaaggaacaattattcgtgaaataacctacaatattttaaatgaccctattgtgcaggatcgcctcattgataatattcttcagatgctgaaaacaaagggttattatggaataaatatgtatatcgaagatattacatcggaaaacctaaataaaattgtagaatacataaaaaaagcttctgcgatatttcattcagaaggttacagagtattagtaaccacaacaccagttatgaatattgatggacctagagtcagttttgaaaagctggactattcacaattttctgaatatgtaaatggaattgtgtttgcttcctatgattgggccagatcttatagctacccaagctcaatttttccggttaatgttttaagagaattattggactacgtcgttagtattattccatctgaagtctttttcctgggaatcaccacactcggttatgattggacacttccttatgttccaggcgctacaggggctactgctatagcaaatgataatgcgatactaattgcagcagaaaacaatataccaatccaatttaatgaagcagcacagtcaccttatttctattatatggatattggtgggattcttcacttagtatggtttaatgatgcaagaagtattgacgcacgagctgaactggtagcagaatataaccttcagggtctgtctctctggacaattatgagatttgatacccaaatgtggtttattattaataataaatattacatagagaaagtctcagtgataaacattgagacataatagttccacagaaaatcgctgaaatccactgacagaaaaagaaacttaaaacttcatagcaaaggcctaataaactgtctataacagtctatcagctaacaaaggcgcaaatatagcggaaaccctgataaaacctaggtttccgctaccaataaaaaagcgcgagacgggactcgaacccgcgaccccgaccttggcaaggtcgtactccaccaactgagccactcgcgcataaacaacttttttattcatttattacaacactggaattataccatatgtctttaataaatgcaagaggctgcaataaattttttgatttttttgtgcaattcatttttaaatctgtttactgattcaattcccttcggttgtaccaattcgcaatcggaatcccaccatcatttgcagttcaaccaccattatcgtcatcaaattcagtagctttttttagcaaataatgataaaataacactatatattgcatacaagtttctatacattcctgtcttgtccgctcctggcactcataaatcagccatgtaccggacaagcttaataaaacaactggaaataagacaaatacaggacagcattccaacgccagcggcgttattacttgacctgtgccgccggtataggcggcagaacggagttttacatgtcactcataccgtttcaaaaattacctccccggagacacacggaagatgcacgccaatatgcataccggattatccggcatttcattttaaatcttcatctgcccccgggccgtaagatgaacgaggtagaacttgccgatgctctgagcataagccggacaccggtccacgatacgctctataagctttcccgtaaaaatctggtggatatcatcccacagaagggagcctttgtatccaggatcgacatcagccggatcgagcagaccctgtggatccacaagcagcttggaacagcgatgcttcagaacatcttcatccggaacgtgaaacggccccaatttgatattctttatcataacctgatgcagcaggaggactatctcgctcaaggagatctatcccagtccgtccgtctgatcactgattactaccggctcctttatgatctggccggcaagatggattacgtctgggagcctgtacaaaaggccggcatggacttacaaaggcttctctacctatctgtctcagatgcttccgtaacagaagatttcctaagggatcttaccgcccttaccgatgcgcttgcagcacgggacacagaccgggcatgcaccatttaccagcatcatctggcccggatccttttagccatatcacctttaaaggaacgctacccggactattttattgaaggcagtaaggggcatgcagattccaaacttcaggaacagaaagggcttctttatgaaaaatgacttctatcagaacttgtttaatctggctggaaaaaaggccctgatcccgggagggaccggaggtctgggaagcgccattgccaaagcttttctccaaagcggagctgatgtggccgtgtgcggcggacatccggaaaaggctgcacaccttgaaaaagaggcagaacagtcaggccgcagttttctttccctgcgctgtgatatccgtgaccgggaggacgtggcggaaatgctgaatcaagtgggcaagtcatttggccgcatcgatattctggtaaacagcgccggaatgaaccgcctgctgcctgcggaggattacgatgaagatacctttgaccaggtcatggacttaaatgtaaaaggcatccacacggtaacacgggctgtgggaaagggcttcatgatccccaaccggtacggacgcatcgtcaacctctcttccgtaaagagccttataggcacaaaacaggattatatcgcctattgcaccagcaagggcgctgtcaacatgtacacaaagcagctggcctgtgaatggggaaaatacggcattacctgtaacgccatcgccccaacctttgttaggacgccgattaactcatttcagttagatgatcctgcttttttagaaaagctgacggaccggattcctcttgggcgcatcggccgggaagaagatatttctgccgctgcactgtatttatgcagcgatgccgcttcctttgtcaccggccagatccttggggtggacggcggcttgaccgccatgcagtagcagaaagctgcagagggaacatactgacaatccatcaaacaggaggagttacccatgatttttggaaatatctataaaaccatgctggaagaacagcttgccgtgctgcctggtcctctgcgcaatgccatcagttatttaaaagacaatgacatggctgctcatgagccgggagtattcaacatagaactggacggcctgcctgtcatcctgcaggtccttgatttggaaacgaaggacagggaaagcctgcgtccggaaatacacagaaagaccattgacgtgcagtttcttgccgcaggcggtcccgaagaggccggcttttacagcaaagacgaaaccgggcaggtggacgaagaccttcttgacactcccagggacatccttttcttccgtaatgactctgaggccccggaagggcggatccgcctgactccaggtacttatgccatctattttccatgggatgtccatatccccgccatcaaggccggagaaaacccggcacctatccgcaagatcgtcatcaaggtgcctctggaaagctgcctgcccggcagcgcccgttagggggaaggatcatgagcctgaaccaatatctgattgaactttccttgaaggatcccgacctgcgccgtatggccctggaaagagtcttaaggcaggaaaacctgccctttgaccgccaggaagaagagccgtctgccaaaactcccagaggagccgtcaattatctgatctccccggaaataagcgggcccagccttttgttctgcgcccattatgatgcagtatccggaagctatggggcaaatgacaacgcagcggccctttgcatcctgattgcccttgccaaagccctccgcaccgaaggcttccccgcccgttttgttttttttgacggagaggagtcaggcaatacaggaagccgcttttacgtcagccagatggaccgccaggccatcaccggcgtgatcaatctggatgtatgcggttacggtgacaccattgcagtctacgaccggggaaatgcaaagaaggcttctgtacgctcgttctgtgatcaggaaattctggcagcccacaacggccttctggtaaaatatttacccaaaagtgatgaagcctctttttccgggcttcgtattcccgcgatcagcatcgcttctatccccaggtgggatattcagtacctgaaggctctttccagcttaggcagcggatttttaggccatcccccggagtttgatatgatactcagtcagatggatgtgtctactaccatgcatgggggctaccgggattccccagaatgggtggagccggaagccatgatccgcatttatgattatcttatggatgcgctgcacgcgccggaaaataaaaaaaagcggttccttctgttttaaatgcagaaggaactgcttttttaagtaatgatgcctaaaaatcaaaggtaaggacgattttgcggatagacggatcatggctgtccacaaagttaaatgcctcctgagcctggatcagcgggaaggtatgggaaacggaaccgcttaaatccagttttccttcatggatcagctcaatggcttttccaaacattttattctgcaaacgggaacctcttacatccagttccttggaggtgacggcaaactgggtgatctccgtaggagaggtggaaaagcccatggtcatgacccgccctgcatttccggtggcctgaagaagctggatcagggaatccttgttgcatacggcatcaatggaaaccgtggctcctctcatgtgtgtatactccttcaccttttcctgcaagtcttcctttaaggtgttgatcgtataagcagccccgttctctttggctgtttccagcttatcatcctggatgtccgcaacaatgatgtggtcacagatcaaacgggctgtctttaaaatagagcttccaagagccccggaaccatagatcaaaagcatgtcatccttattcagctccgcacgggtgcaggactggatgccaatggtggcgggctcgatcataacggcatcttcatcggaaagggaatccggcaggatgtaacagtcagactcaggtacagccatgtattcacggtagccgccgtcaatgtgaacgccccgcactgccaggtgatcacagacattgccccgtccgatgctgcagggatagcaatggccgcagcttgttacctggttgatgatcacccggtcaccgacttttaaattcgtgacagaagggccggtttccgccactcttcccaccatttcatggccgatgatcctgggataggtagccgcagcattggttccatgataaatgccgacatcagagccgcagattcccgcagcagtcattttgaccagcacattatttttttcgtcaatgaccggcatgtctacatcaatgacctttaactcataaggttttacaatttgtaccgctttcataaatcttaaatctcctttactgttcttaaacccgattccggtgacttgtatactaaaacactagcggacctccaagtactgtttaaggacctgctccatctcggcctttttctcttccgtcaggggcagcatgggccttctcacctctcccgccgggatgccctggctggaaacaatgtactttaagtttgcgcacagtccgttctttaaaagcacatccaggatgttattggatttagactgaagaattctggcctcttcttcctttccgtccagatacagctccataatacgcttaaactgaggcagcataaaattgaagctgcttccgataaagccttcgcagccaaatgcaagaaaggccaccatgcagctttcaaaaccgccgaagcacttaatatccggatttatattcctcaaccgctccatttcaaggagatttaagttggtgtgctttacggagccgatgacaccggattttaaaagtgcctgaatatccgggttggaaagctgaagctccttatgggtgctggatgggatgttataataaagaaccggctgtcccactgcctctgcaatatcgtaataataccctgcgatctccttttgggaaaatccaaagtaaagaggcggagttgctgcaatattccggatgcccatatccttagcctgctttgcataaaacacggcctcctccgtgctgatggcccccacatgggcgaatatgtctgcacgttccacatattctgaagccagctcaaaggaacggaccctttcctccctgttcagcaaaaagcattccccggagcttcccccgatgaagaatccgtccgccccttctgaaaggtttctttcccacagctgctttgcagctgattcattgattctgccctcctcttggaaaggtgtaatagaagcaacatatatttttttcatggtttgtaatcccccttatgattaatcgttcccctgttcaaataccaaatcacttctcctgatcaggctgttccagttgcatacctcacagcaagacgggaaatatttaacttcgcggacgatcagcaaaatcagtaagcttgaccttgtcctgcttccttttcgaaaataaaaagcaaagaggccggtatccggcagcgcatacaccctgcggcaggaaaccagcctctttctatatcctgttaccggctcttgtcttccatagcgtgtatcgtttccaccacaaattcgtgggtcggtaccggaatgccgcatttccttgcagcccgaactacggagccgcttatggtatcaacctctgttttccgtccgttttgtaaatccgcccggatggaagtgcagcccttaggagacatttccgaggtctttctcaccttttccatgatctcctcatcatctgcatgaaggcccaggccacgggccacggcagccgcctccttgatcagacgggccgtcatgttccatgcatgttcattggacgcaatatatcccatatccacctgaagaatgcctgtgactgcgcttaaggatacgttggtaaatagcttgttccagataagctgctgaatgttggaatggacattcactgtaaaaccgcagcattcaaaggcttgtttcagctttggaagaaacagctcctgatcctccgccagcatacctacgttggtgtttccagcgccgcctctttttacatagccaaggcctaaaactgcgccattgtcttccgtggtgccgatgaccatatgatccctggaaacaaactcctccaggatgtcctcatggccggaaccgttctgtaaggtcatcacataggtttcaggaccgatcaggctcctgtttgcctctaatgcccctttggaatacagggatttcacgaacagaagtacaagatccaccggtttcatgccggctgtagaggtaacggcattgggacggtaaacgtgctcctcattattttccagaagcttaatcccttccttttcgatgtgttccacaacagcaggcgccgtatccaccatatatacttcattatttaaggacaaatgggcaccatagatggaacccatggcccccgcccctatgactgcaattttcatagatttcaccctctgttattttgaaaattccccaagtccctcaatggcataagcgcggatggggcaggaatccagtcctttgatcggaatcggagcataagacatgaagaatgtgtcagtggtcagttcttctaagttctttaatacctctaagaataccacatcaacctccatgagaacatcatggaatgcgcatacatcctcgttgttgctctcaatggaaacgccgtcgccaaagccaacgcattttaccttcttctcctttaaccactctgctgtctcccggcagatgaaaagacgctcatcctcaggagtgttggaagcaggggtgaacggcggaatcttccggggagaatccaggatcacaatatccccctctttgatgcggccgccgcaggccttttctaaatcttctcctttgattttgccattgggctccatatgggtgatgttcacataaatggcacgtcccatgaaggtgctgatgggaagcccctgtacatcagtccaattgtcattgtggtgatatggacactccacatgggttcccaaatggctggtcaagtccatgatggtgtggaaatccgggatcggaccacctgtgttaaagcggaataaatgacaacgtcttgtctcagtctccggatccagctgctttgttaaatcaatgactcttaacccatttcccagttcgtatgcgctcatttttatacctcctgctttataatataatttattttgtgaacgaatgaatccactggatgtgcaagcatatccgcttgattcacaaactcaagagtgacagagttttctttcactctttctttttattataccagtataccggtataccggtcaatctttttttattgacttcacggttcttttcgggtatgatatgttccataacacgcacatccagacaaggaagtctggtacttcaaaacgacaggagttttccatgaacgataccggttccctccaatttcaggcttatcatacaatcaaagaacagatcctatccaaatcccttgactcagaggttttatattcagaaaccaggctggcaaaggaattgggcatttccaggacaccactgcgggaggcccttcaatatctctcccaggaaggctatatcaccatcattcccagccggggatttaagatcaggcgtctggacaaggagaccatgaaggagtccattgaagtccgctgtgccattgaaggtttttgtgtccatctggccgttgcctgtgaagatggaaaacggcttcaaaagcttttaaaggatatggaagaatcccttacaaggcagaaagctgccctttccgccaggaattttccggattcctttacagaagaggaccatcagttccacatgcttttggtccatttcgctgagaacagcgaatttgaccatctgttccagcgtcttctctataccatacatctgaccactgccaatgctctgtccatcgccggccgtgcccagtcgacctatgacgaacattccgccttttatcagcatttgaaaaagagagaaggcagccaggcctatcaggtcctcatcgaccacctcatgatgcctttgaacatgaatctcatttgattttctctgtccggcccgggttttccctgtgccggacagatttttatttaaagagcgatcttgactacgaccttttttacctggcagggttctcctgctgcacagcgaggcttgtgggcatcttccggagccactacgatcaaatctccctcttccagcagaatgctgccgctaagctccggttcttcataaaagatcacatcgttttcctctattctctccttcacctttaagccgtcccttttacaaacgccgaactgttccctgccggaaaccatgtactgaatatcaaaatatttctcatgggtctcaaaagaaccctggtctgccggaaatgtggtgtactcctgtacatttgccaccacaatattttctttgaccggatagcttcctgccggtaaagaacggatatccgtctctttcagccactcataggctgcccggaatttatcttccagataatcgtatttttctgcaactgaaatattagaaaaaagcataagttttctcccttctgctccccacgaagagcagttccttttatttgcttgcaacatcctttgtatccagccggccttctgaaatggcaacgacctgggcccagacagtctcatccacggatacgccttccttcatgctttgttccctggatgcaatggtccgttctcccggacaggtgacctggccgccttccctctcaggatggctggcatctgctgccgcaaccctgcggttaagcatttcctggatctcctcttttgtgccgaaaagatatggatcataggcaatgaaaatctggcagcagccagtgcagcttcctcttccttcctcatctaaatcagaaccgctgtttccgtttgccataagggcagccgccagatccagagcaatggccatgccgcttcccttccagtagccggtgggaagaattctcatgctctcttcaatggctccaggatcatccgttaaatttccttccttgtcaaagcccccggggaatggaagttttttgcctgccagacggtaaacccccagttttccgtaagcatactggctcatggccatatccaggacaatggggccgtcttctcttggaatggcgatgcagaacggattatttcccactcccggcttgtcgctgccccataaaggcatacagctttccgtattgatccagctcatgcccatgaaaccggcttccgccattttccatgcataggtgccgccccgcatccagtgggtggtattccgtaaggcaacgcagccgatcccatgttccttggcaagctccatggcccggtcagcacaaaacagggcattggtaatgccgatccctaagtgtccgtcataattttcaacggctcccctggcgccaataagctccggctctcccttggggtccacccagcctttctgcacatattccacaaaacgggggacacggttcagtccgtggctctccactccgtcagcactggactgggcatggatggtggcacagacctcagccttttcctccgtaagcccggcatttaacatagccttttttacagtttcttttacggtttcataaggaattcttaaactcatatcttctcctctttcttttaagcggtccgcggcgttcttcccgcgcaaaccatcatctcttcataaagtccgctggcttcttccggtgaatagccatagactaaaaatacatccattacatagggggaataggtgattcccatgatctcctgggcaaaccccattgccgcgatctcactgaaggcgatcacattggaatcgttatgaaggaacccaagggaccacagcctgaccttttcggttttcgtgaaaatttcattcttgtactgttcttccacacaatgaaaaagctcatgagacagcagaagccggctgatgtccagccctcctgccagcagttcctgaatttccggtctttcaatgagcttctccgctttcttcaccgcgtccatatagatgcagattttattgggcacccggtattctgcaaaaagcacccggtcggttttttccgggaattccggataggaaatatccatgcccatggcttccgccattttctcaggatccctggtatggtatttcctgcagattttctccgcatattctcttccgcaggccaggcatttctccatccattcccttcgctgttcctggttgaatttgccgtttaaaggctctctggaaaaggcataggaaaaccattccactggttcgatttctgccaagtcctttaccatgtactcaatcggacgcacatcaaagtgggggcgttcatacccgcctgtcctctgttttccaaaaagtccgtctgtaatgggctttagggcattctgaaactcttcctttttcatgtttgtttagatctcctggacggaagctatgataaggacctcctcctctggttcccggtctcccagatccagattcataagaagcagaatctgttctaagtccaccgcactgtagtcgcatacccttggtccgaaacatacgaagaagtcaggacgcagtaccgtatccgtcttaaatacggcgttttccttccaaagcttttctacgactgcttcgtaatcctttaccttgcatttctccacaacgccgtctgaacactgtactttaatgaaccccttgctgtctacgatccgcagcggtgttttgctgtctttttctcctttataaacaaagaacttgtctgtcttctctgccagtaccacgttggaaatctttggaccgaaatcctgtaatgcaagctcgcaggcctccggctcctcgcaggcctttaaaaggtctgtggtcttcacctctgtggatcctgtggctatggccgttaccttgcccgtctgactgtcgatctcaatgtggatctccacggtgtcaggagatgcgccggagctgaccgccaggtccgctgcctcctttttcaattccttaatgtcttcctgggtggggtttggaatcacgcgctctaccacgtcgcggaccatggacagagccacgccgatggaggagatcacttccgcattttccggtatactgtactgcaatcccatctttcctgcacagtaagggaccagagaagcagcgccgccgccgcagcccaccagcctcatgctgtcatgatccagcttgtacttttcagccagggagttgatacaggcattgatcttttcaaagtccttgtcaagaatctgggtagccagctcttctatagtaatgccaagcttatcggcaaccggcttcatggcctttctggcggaattggcattgccgtgagcaaagtattgttcatcaataaggcccagcacgtttgccgcatccgtattggtaaagcaaatgcgctttccattttttaaccgcagggtcacatagtcgccgggatctcccggtttagggctgaccatttcgatctgtggatcgacgatctcttcttccggcataaagcaggcatattcacagcccgcgatatgagcggaacggggaccaacgtctaccacacatttgtcgttgacacggaccatggaaccgcctgcacagcctaaaatccgcacatccagggagttgatgtaggtgtcgtggcctccgatcctggcataatccacgccgggacggccgttctttataacaccgatgttggtggtggttcctccaacctcaaaataaatggcattggaagcacgaagatacatgagagagcccataacggaggctgccggaccggagagggccgtcagaatcggacgttttctcatttcgttgatctccataacaccgccgtcgcctctcatgatcattaagggcacgttgattccagcagattttacggaagattccgtagcgtttgcagtcatcatcattttgggcagaatggaggcattgattgccgccgtacgggtccggcgggtgagtccgtaaagtttcgtaatatcagaagccattgttaccggcacatttttcctctttgcacagtcatggatcagctgctcttctcccatgctgtctacgccaaacgccatggaagctaccgctacctgggcgccctgggccagcagatcatcgatattcttgttgatgacctcctctgtcagcattttcttcttaataaaagtattatacaccttgatcatacggccaactttttcatccagcacaatgtcctttaaagccaactggcgttttgccagaaagccttccaatccgccccctgctactcctacaactcccacacttgccacatcaccctcaataaaggcattggtagcctgggtggtggagtgagccacgaaaaccacatcatccggggagatattgctttcgttcatgcagtttctaaaactctgcacaacaccggcagcaacgccgtctttatggtcatgtgtcgtctttacctcattttttccgataatttcatgggtatcgttatccattgcaacacatttggtataggtaccgcctacgtcgattcccatacgaaccgatctgtgtactcgttctgccattattttccattcctttcctattttattgccatgaattctggcataaaggtatacccgcagggtgtttcctattttattgccatgaattctggcatagaggtatacctggagggtatttccacatttactgccagttatctggcataaatattttttatttgaaaaatctatgatcttgcaccttagtttttacaatatttaatctctcattcagataaatggtgaaaagcgtccgggtgcgcaagggcgcgcccggacctatgggtgatctatctcaggtttggagagagtgattttacttatttttaaagaagttccatttgcctgctgctcaccgaatgctatttttctaattcagactgcacttgcgcctttcttcattaagaaaaatatgcctatgaaaggaaccacgcggctccaagtccgcccagcataataaaggttgcaacatactgcagtacaccggtaagatatgcattggggatggatagctttaagaactctctggactccacttttgtataagcaagtccccatgcaacccatgactgagtgatacagcttccgatatttaccgtaattgtcggaatggcaaataccgcatataagaacggaacagagaaggaagcaacattggacaatacgccaagggttgcggccccacagccaaccagggtcattggtccgcggaacaatcccatgcaaagcagaacagcgaatacgatacataccacgatttcacttcttggcattacgttgcccagaatcaccttaaaataaggagaagcataagctgccacctggttaaacataggcagggtaagaaggaagcctacaagcggagcagtatcaaccacaccgtcataatacagcttattcacaagctggcagttctctttgaaggttccattcattcttccgcaaaggaacagagccaggaatcctgcgatcacaaagcctccgattacggagaaatccagccagatcttaagaacaacaggaacgatcggaaggatcaaggtgtagaaaggagcatttttctgttcagctgcgccgctgcgggtctgtgcagcccaggcatgaacagtttttgcacgctttaagtagaatgcggccagtaccgttgttgcaaccagcatgatgatcagggcagcataaccccagtgtgatgcataccagccaagagtaaactccggcatctgctcaggtttaatgaagaatgcacggtactgtgcaaagtttacaggatttaagtaaatgcctgctgcaacagagcccatgaaggtgaacagggcaacagacttgggaatacctaaagacataaggatgggaagcacgataactccgattgcgataaccgggccggctcctgtcatggcggtaaagatcagcgccgtaacgatgtttaacagtgctacagtaacaaatggcttatctccgcctaattcaacagtcttacggatcaacgtggaagcaattccggtatccataagcacgcggccaaaccatgcaccccaacagacgtttaccagagtggttccccagccttcaggagcagactggtaaatcttgtttaaggcagcgatcagtgtattgtcttttccaaactgcagaatcggattggatgtcagaaatgcctcgcttgcaaaaaatgttcctccaattggaaggatggtccaaagaagcgtaatcagcaggaagccgatcatcaggttatgacccttgatacagtaatacgccaggccaaagaaagaaattaataaaataataccaataatgtactccaaagtaatacctcctatgactttttattctccactcattgcaactactcctgccgttcattaaaacggcttctctctcaaaccttgcccccaaactcctttccttttttctgcccatgcttttttgccgggtccgctccgctttatcgggcgtaaagggatacccgcagggcgttcatcataataataaaaatttatttccatccggaccggcttttaagcctggccggaaaagaactgtgggtaaattccccgaagcgttcccgcattccagagaaccgaattaaagtggttggcgcagatcaggcatgcggcttccgcatcccggcgccttaaattatcgagcaaaaggcggccctccacctgaacatgttccagactcgtcagagaagacatatctgtcttatagttaaacgtcgtatactgaagataattcaaacgcagcagatcgcagtccatggtccggaagacctcccagacatactcgcggccgcaaaaggaagaaagcagataatgaagctgctgctccacgatcagaaaatcaatgggattttccttatttgcctcgttcttctgataattaaggacctcttccagctgttcaagctgagactttgtaagcccctgacggcaaatttcctcaatcattgcctgttccagcacgttatgggaaaaaacggcctgtctgatccgctcgctgtcaagcagagtcacctcggttcccctctgtggatatacaactatgtatccttcttccaccaggcgggaaagggcatccctcaccatggtccggcttgcattcatctggctggacaaaatattttcactcagccgctctcccggccgaatatccaggttcagtatctgcatgcgcagctgattataaatgtcgcttctctggtccccttttcctacttccacttctgtcacttcttctgcctccctgtaaaaacagccggtatcccagtgcacacaagcatttatcaagattgcatatcagtatcccgccaaatgcatatcagtacccaaaatacgtccttctgtctttcttctcttgttgttcactttgtaaaatatatcatatccactctttaaaatcaatcattttattagcattttttacattatttttttaccaaattttaatcttattgttttttttacaaataatccccgaatttttccaggaaattgccgttccaagattgcatacaagtttgtttttaacggttaaaagccttttgacataccgcagggaagaatcagacagacaattctttttccaaatacaaagggagcctcgttccatgaccgaatcacggtcatggaacgaggctccctttgtaaaggatgaatggtggtctgcagatgttttccgttacagtcatcctcctcttatttcctttcggcgctgcaaatgaatgccaatatgtccaatccccagaatcactgcggagatcataagccataccacgttcccatagacgcccagaagaaaaaatgcggcaacaggcaatgatgcgccggccacagggattcccaaaaaactgctgtaaaagtccggcaatgtcttcctgcttttaaaatatctgatccaccacccttcatacaggatcattaataccactgctgcaaggagccataacgaccataaggaccacttataaagattaagatcagaaaaaatgagagacgtgcaggtgacaagaacctggcctacacgttcaaagatcaataagaccttattctcaccatgaaagtcatacccttctggctgatatttcgtccatatcacattaggaattactaacattagtaagaaaatcaaccctaaataggaaaaacccaagtgccccatcgtttcatctcccttttatcccttttccagtataccccggtatgcggatatcccgccaatatccgtaacagaatagccattggcccgaagataacggcaggcctgtccgctgcgcgctccgctttgacagtaaacaaaaacaggattgcttttatcaagcttcatggattccagccggtcaaggggcaggttaatgctgccggaaacatggccgcctgaatattcctgtgctgtacgaacatccagcagcactgcatttggcgtgtttcttgcctgttcaattcccgcagcaaaatccgtacggtttgaaaaaaaactgaatatacccatttcaccatctcctttccattctctttgattttacatctgagaaagaaacagacgcaacatcaacgcttatgccatgttttcagtatacctggtttatgaatatctctcagtgacattgttacacatacaggagttactgtcagtctttctgattcctgcgcccagcaggactgtcatatatcacgattcggttcctgccgttatttttagccgcatacagcgccacatcagcggcccttaacagctcttcatgactggtgcgctgaagatccaggcaagccagcccgcagctgaaggtgatgttgtttttatcgatctggtttaaagaggaggcttccataactgaccgcattccttcacagatcttatacgcctccttttcataataacctttgaaaaggattgcaaactcttcgccgcctattcgaaatgcgttgatgttctcagccccattgcttttgagaatctgggccagatggagcaatacccggtctcctgcggcatgaccgtactcatcatttacccgtttgaatttatctacatcaatgattgcgagggaaagacatatattggcgcttctgcattcttccactgtttcggataaacaggtgtcaaaggttccccggttatacagtcctgtaaacggatcgagctttagctgttcctgcatattttccttcatataatataaatgcattaacgacataagattattatgaccatttaagatcataaccttagctaacagatatgagcataaaagaatatcccacgcaacaaatattgccatgagcacaccgccgtcactgtccccgcctttgagcagtatgatcccgctggcagcaagggcagcgctgtttaccagaaagatccgccttgtcatcttcatatttgcaaaaatagtagaagcaaatacagacatggtaaatgttccaagcaaaacagtagccatcttgtgagtggatgaaaggtaaaaggaaagggccgtaaaaagcatcagcaccaggtattcctttaccaaaagaggaatattgggcaaacggacaagaaagtctgctaacagattcaaagccagaaggccgatagcaggcagcacaatataacggcgcatataaacttccggcgtcgaggcaagaatgctttgcgctgcaaagtaccagatgatatgtgccaatgtgatcatagccacagtggcataaccggcttttacaagatagcggcaccattttatgggcctgataacggcacccgcctcattaaactctaaatcctgatccataggcataattacacctccccaaacgcttcccctcccgattatacttgaaaaatcagcaaacagcaatccgcttttgtatctgaaaagcttcatattgtaaatatatttccaaaaatcagaatgcgagggcaggtcatggcctatgatcgaaaacaaacctccaaatgggggatatgcatcaccacggcctttctttttcaaaccagccaagggattcccagtaatgcacatctgccggattgaacttaaatttctgctgcataaacctcataacgtaaaataaagctttggtcttcatggaaggggtcacatgtttgtccgtttcttttatcccggcggaaagtctgtcaatttccttttgaagctttaactttcttttctcatcaacagtatcccagtcacttccataaacgttcctgccgaaagtatggatacgggaaattccccagaaggtcatgctgtcttttatatcccggatagctgatcttgttcctgcgcctgcggccgtagaaatgagaagagcctgcttgtgaaacatttcctttcttggctgatgagccatccattgatatccaaaatggtcaagaaatgccttcacctgccccggaacgtgatagacatagaccggcgctgtaaaaaccagcagatcagcctcaagcatggcttccagaatcggctttaaatagccataatccgggcatttcctgtaatcggtaaaacagttccagcaccctttgcagaattcaggcatatctttcggaaggaaaaactctcttacttcattctgttccgataagttccgtataaaccgctgggcaatgttgtatgtgctggattttgattttcgctgagttgcataaatcaccgtaattttcatcattcaatcctcctgcaagagaattctcaaaaaagacaaaggaatggaaaggcacaagacttcctgtcatagtatgaccggaagtcttaaacagagcgtaatttactccacatattattataacagaacacaagacgcaataaaagaaaaatcaaaaagggcagataaaatcctcatttctatgcttccactccaaaatgctcaaaaaggattttctcggcttttgcacaccaaagtccgcggttctccctgcatacttcatccagctttttaaataaaggatccgtttttcccaattctccaaagtcctcaatggccgtcagaggcatatcaaactgcgtataggtcagcttctttcctcccggaatcctgggaaggttcaaagtcgcttctgcaatgctgtcaatgccgcctacatgggtcaccataactgccggttcgatctttccctttgccgccagttcatttgcttcgattaagtcatcattattccctcccgttgtccccataacatgggcgctgatataatggacattatagagattgatctcagatttaaactgattatctgtggggccggcaaaaaagtttaagcagccgtcaaatgccagaagctgatctcccatttccgccactttgcggttgggaatataaacaaacacatcgtcatagccctttcctccggtgaccgcccgaagctccgccaccggatcagccattttcccggtattgatgtattgaagctccactccgttttcggcggcaaattcttccggtatgacttccctggcccgttcaatctttgcgtcatcgatatccgtcacaacgattctccttggtttgttccggtactggattccgtagcttacggcccccaatcccatgggaccgcagcctcccaggataatgatgtccccatcctcctttgtgccgatagcatgatcatggtttctcttattggtgtgataatttccatgataccctccgatgatacagctcatgggctctcccagggaagcctcaaaaaaactttccccctcaaagggcatcaggcatcccagctccataacttcatgtggaaaaatgcagtaggtgcaggcccctccgaaaaactcataggaataaccgggagaggccaggcttcccttgtaatttaaagcgggctgctgggcaaacttcattcccggcttaaactggtctttccatttatctccaacctctacgatcacacccgcgaattcatggccgataatcaccggattggtatcgatattctggggcgctcttttatgtttctttccctgttccaccagcttataggtggacatgcagatgctgtcactcatgactttgacaaggatctcatcctccttaatggggggcagctcaaactcttccagccttaaatcccgttcaccatacattcttactgctttcgttttcatttttttcttttcctttcaactcttttatcattgcatctgtcttttaagcttccattaactccaatcctggagcgtcccttcacgggtttctggaaaaaatgtcccaaaggtccattgccgaactgatatcttttttcggaccatgacctttgggacaccatcattttagtttaattctgcatacagttcattccacttgttaaggatttcatctttgtgctccgctaaataagcaaagtcaagatccctgatatataatgtttcctcgtctggcagaccgcttaaattgcacagtccattggagcctcgtcctgcagaggcaactgcgcgggcatcctggaattccgcagaggacaaaagatccatcatggcctgggctgccggaaggtttggtgcactcttcacgattgcggcgcctcctgccattgccgtatttccctcttccatataaacacactcaacgggagctccgtcattgatcaaggctgctacacttgattcataggaaagacctgccacatattcaccattgctgacaaggttataaacatcctttgatgatgtggtggaaaagcttgccggaatcagctgcttaatgtaatcccaggatttttcatcgttaaattcatcgcccataaccgccagaatggtctgcagctgacgccatccggaagatgtggaatccggagcagcaagaatgatcttccctttcaaagcaggattcagtaaatccttataacccttgatctcaattccaagctcatcccttaaggcaggatttacaacaagacacattacctgtacatcatagaaggtataatatccggaatcgtcatggtacccctgctctttgtcacacgctgctgtataaggctgaaggatatcgtgataggtttcaccgtcagcagcgaacatgccgcctattaccacatctgcatcacaggactcgtcacttctgattctggttgccagtgttccacggagtccgcctggatttccagttcacagtcaggataatattttttccacatatcacttaaaacctgctgctgggtctcttccattgtggtgtaaaccgtgatcttcccggtcacctcacccgccggtttcacataatagggcaatccggaagcagttgtttctgcagccttcgtatctgctgattgagcttctgtttttgaatcctgtgcagttgtttctgcttttgtctccggttcctttttcgtgctgcatgcagtcacggacaaaaccatcaccgctgcaagacctgctgccaataaccttcttttcatcataatttcttcccttctctctataaattttggtttcataaccatttttacaggcgcacatcctccatcttggtacatattaaataaattgccagacaaagtactgtcagcaccattgtaattgttgcaaatactgctgctaccccgtaaataccgctgctgattgcggaataggtgctgattgtcagagtaattgttttattgttatacagaattaccccggaggacatctccgtaataattgacacaaagcttaaaactgctcctgatatgattccgctggacattaacggcactgtgatctttatgaatgcggacaccttgggagcacctaaattcagggctgcttcttccatgctcaccggaatcttcatcatggccgccgtcgcggaacggctggtaaaaggcattctccgtatggcaagggcaatgatcatgatgaccagcgttccggtaagcgtaaacggctttctggaaaatgccacaaccatggcaataccaatcactgctccaggcatgatataaggcagcatggagatggtatcaatggcattgtttaagaaattactgcgcctcaccaccagataagcaatcaaaactgcaatgacgataatgaccgccaaagtcacaatgctgacaatcatggtgtttccaatagaacggaacagcattttttccattgctttctgataattgaccagggaatagcctggttttaaaatactgttcttataattccggaaagacatgttcactatataaatctgcggcagcaatgaaatgcccacaagaagataacagtaagcatgcatgataatattggcaaaccctgagacagtcttaggttctatggggtgaagagcgcttatggtaaacttaaaccggttggacgcagtcttctggatcaggaatatgactgcggttaccagcaccgcaatcacactgattgcagccgcaaaatgataattggttccattttcaccaaggtactggttataaatcaggacgggaaatgtgctgtatccgcgtccaatcagcaccggcgttccaaagtccgcaaaggatctcatgaaaaccagcagggccgccgccagaatggtgggcatggtcagggccatgattacccgtttaaagcggtcaattcctttacagcccatgctttccgctgcttccagcagggaattatctatatcccggaacgctccgttcatatagatcaccaccagcggaaacaattttaaggtttgcacaaacacaattcccccaaaaccatagatggaaaccccggaaattccaattgattttaaaaatcctgtaatcagtcccgaatttcccataagtaaaatccaggcataagcgccgataaatggagccgacatggtgcagagaagacaaagcacaaagagcaccttccgtcccccagcctgtaaaaagaataaaagtaggcaaagggcactcccaaaagcagactggaaaacataacgcagaccgctattttgacgctttgaaaaatggagctgtagtaataggatttgctgaaaaactgatgaaaggcatcaagggtaaatttaccgtctgcatgaaccgcttccatgagaagcttcccaatgggataaattaagaataccagaaatattaccagcagccccaggaaactgcactccaaaaatcacctcgttttttccggatcatcccttcacctcctgtctttcgaaacctgttggcaggactgtgctgttttttacccccttcatcaagctgcatgtggattcagaatcaaatacattgaccttattgatattgatcgtcaggacaatgtcacttccaggcgaaatgatggaatcaatctcagattcctgaatgatttccacctcttctcctgtttccaactccgcaaaataatgggtattcaatcccagaaatacgctgtcacggatcactgccctgattccctgtccctttgatttgctttctgatctggagacaatcagctcctccggccttgcagataccacaacctctctgtccctgatttccttatttcttatggaatcaacagaaatctcatatccgtcctggaatacaacgattgccttttccccttcttttctcagtctggcatttaaaaggtttgatttgccgataaaggttgccacaaataaatctgccggcctctgataaatattttccggtttcccgatatgtcggatcactccgtctttcatgactgcgattctgtccgaaatggccattgcctcttcctgatcatgggtgacataaacggtggtgattcccacctccttctgaatccgcttaatcacactgcgcatctccacccgcagcttggcatccagattggaaaggggttcatccatcaaaagtacatctgggcggattaccagggcacgggcaagagctaccctctgctgctggccgccggaaagccgttccggcattcggtccgcatactgatccacatggaccagctttaagaatttatccgcctcctctttcatctgctcctttgacatgtttttgtatttcagaccgaactccacatttttgcgtaccgtcatattggggaaaatcgcataattctgaaataccataccgattccccgcttaccgggctccatgtcattgatcactttatcgttaaaccgaaagcttcctccttcaatggaattaaatccggcgatcattctcagcaatgtggtctttccacatccagacgggccaagaagagtaaataactccccattcccaatggtaaccgacaaatccggtatcactgtcactgttccatactttttcaccgcgttgctaatcgaaatcgttacactcacttttcctaccgccttttggatatattgtatatttttatcactcaacaattagtattttatacattttcatgattgttttctacccaaaatacagtcttaatggaaaaaataccaaacaaatgctcatagcaagaaaaaaagcagcttttatttcagctgctcttttactttccacgaatactctttcggactgcaccctatgtactttttaaataccatattaaaatatttgtaatcaccgattccgcacatccaggaaacatcctgaatggttatattttcctgcttcaagagctccaccgccttttgaatgcgaaagcggtttaaatattcgatgaacgtggttcccatctggtttttgaacttccggtttaaaaaagtctcgctgtaattcatggcctccaccacatcctgccagcccattttttcctgataatgatcttcgatgaacttcagcaattcttttacaatatcatcatgttccccgttttcctctgctctggaaaccagccttacctttttcagttcttccgcctcctgctgctgggcaagccaggtctgatagatccagcgtttttcttttgcattctcaattgcctttactaactcctcccgcttcagcggctttaagaggtaatccgtcactccgtagtggatggcactttttgcatattcaaaatttgagtatcctgacagaattatggcggaataactgtattcctcattcgtctgccggatcatttcgattccatccatcatgggcatattgatgtccacaatcaggatatccggtctcatcctttcaatcagctccattccctctattccattgcgggcctcaccgactatggtgcagtccagctctgcccaatggaccgaatacatcagccccttcctgataatatcctcatcttctgctattaaaacacggtacatttcatcaccccttctgctcaatccgaaccgttacctcaaaaccaataccttctctgtttctgattaaaatcccgctgttctctccatattgaagataaagcctgcgggacagattgcacagcccaatggaggaagaactgttgtcatgctcctttaactgccgctccagctcctttgctttctgaggttccatgcccaatccatcatccaggacatggatgaccaatgtatgtccatccatataaccgtgaatcaggatatttaattccattttcttttgaaaaccatatttgatgctgttttcaatcatgggctgaagcagcattttaggcacaatacactggctgcattctgtctcaatatggatttcacagtggaaacggtcaccaaagcggcaattctgtatctccaggtatgcatcaataaactgcatatcttcttccagagtcatttcttttcggatcgtattcacgctgtagcgcaaaacctccgtcagctttacgatcagctcttccgctttcggcgcatcaaatattaccagattccggataatttccaaggtattatagagaaaatggggattcatctgctgggtcagctgttccatctcaatacggctgttgagcttaagcagctctgtgtttcgttcatttaaattctgtatgttatccagcattcggttcacctgatgccccacctccccgaactcatcatccgttccaagctgaatccggtgtttgtgatcccctttctggatcatgcggatctctttcacaagtttttcgatggatgcggcattgttggcagccatggtccttgacatccagcatgcaaccgtataccagcacactcccactgacaaaagaattaaaagccctatggataccgcctggttccggggataatgtaccagggaatagattacggctgagtattccggcagctcttttgaaacactccaataccggtcccctttactttcccagattccatgccccactccataaaacttattattgctgtcagccagccccggtttacttatgtacatcacattctgtctcatatctgtgattacaccgtcaaaactgctctcagagagataaaaattccactcgctgccggacaggaataaggtcaggtacccctgaatgcttccttcttcaaaaatcggctttacaaaaagggaatccgcataatttcctctgtcataataaatggcccggtaaatttctccctctttatgatttcttgcattatagcagattgcattattataattcagcaaataggaggaaacccggttctcattgaaagaagtaaataccaccttgccgcctttatctacaagcagaacctcattgtgaaccttacattcctcattaaactggcggaaaagatttttaaattcatctgctgcaccggaatccggctgtgaaagcatcctcctcacaatatcattgatccggtcattcagcaggaattttctattctgaagatcaagatcaaaaaatgtttctttcaggcgttccagatgggaaaccgcgttcagctcattttccgtcagagtaatgatcgattgtcctgcccaaaagaagaaaacgctgattatcatcagcagaacaatcttcctggttaccgacttctgtaagtttttttgaaaccgtccctcttccggaactccgtttttattggaaggatgtaaaacaaatcccatagtattcacagtcctttcccattttcatcaattccacccctatttgtcataaccatgattttttctttcactttatcatttgtcccggttttataaattttaacaataaaggcatcgctgaacagccattttttattaataattctattataagaggtgtattggggtttttcaataagaatcggagtcatccgctcagccgggcactgacataagaaaataaaaaagaacggtgaggagttttgcctcaccgcctgcacattatgcttataccgtacatttcatcacttcaaatttattcctgccagaacctcattggtggtaataccgttataattataaataagctcatttatgtcaaaaggaatgcccgctttatcatcaagcttaataagtttatagttgttatgcaaacgttccgtgttacgcaatatggattcccgaatagatggcttggttatctcacccgcattagttaccacattatgtaaacttccaaattgattaatcagtgccgccgcagttttcggcccaactttttcagctcctttgatattatctgaaggatcacccgtcaatgctttgaaatctgcatactgaccaggtgaaattccatatttattccggatatatgacggatcacagagtatggtatgatcaccccggtatcttagaatcgaaacactgtcgttaataagctgaaaaaagtcactgtcaaaggatgaaataatgatctccattttcttttcatattttaagacatagcttgaaataacatcatctgcttcatgttcagcaatctctgtgtacttaacatctaaaaaatcaagagcatgatatatgtctttaatctgcgaaaagggattgttttcatccggaactgtggagtagtctatacgatttgctttatagtctgcaagtaatttggtacggctgttttcatgttcaccgtcaaataatataataagatgtgtagggcttgtcattttaattattttaataaacgcacccacaaagcccagtaccccttgaatggcctttccatctttatttacgattcttgatgacatgccgaagaacatctgaaacagcaaattacatccatcgacgatcaatagtttttccatagggtttacctccatacttcatctgatcttattgcttatataaaaatatagatcctattcacttcttcccagctactatatcacagctttatatgatatgtccatgcctgacaaggacagcctcagttcctgttccctgcattgcccccctaggaatagggaccggagatacatgaatttcctcgccaaaggataagacatctcttccggcagtatcgataattacataagcctgacaacccttggctattttatttattcaatttatttaattcatattgtatccgcaataggaacataatattatttacaagcttataatccattattaccttttctgactgcagggtttacatgaaaaaaacaatagttaacaattaaacctaaggcttcctattggtgttaaagctgaaaggcttgacgtttttagtccttgcctttatcatataaacgtgaggtttaaacctgccacaaataccttttgacgatgtatcatcttttgagacgctaaggaaaacacggaaaatcctgatccggcatctttccatcatgagagaaaacaggacagccaatcaaaatagtgtatacagcaatgggaggagaggattaaaaagaaaatctgtaaaacagtttttcataaagaagggagctaaacaagttatgctaaaaatagcattatgtgacgataaccgcagcgcgatcaagagatatgcggagttaatttcccaaatcgcggaaaagcatcagataaatatcgagctttcctatttttatagcggagaatccctgctttttcattattctgaagcacctgaacaaacagatattatatatttagatatcttgatgggaaaaacagatgggatggagacggcccggaggctgcgtgactgtgactgcaaagcccaaatcgtttttttgaccagttatgaggattatgtttatgaggcctttgatgtaagtgcacttcaatatctgttaaaggaaaacacaagccccgaaaaatttgaggaagttttcttaaaggcagttgaactcgcctcgaaaaaagatgatgaattatttacctttgagtttgacggcaaaaccagtgcggttcctgttaatcaaatctcctattttgaaatttggcagcgaatcgtaacggttcattacagcgatgggaagacagcaaaattctatgacagtatggagcacatagaaaataagctttccggaaaggactttgtacggtcccatcgttcctacctggtccatcttccctacatcgtgacgtttaagcagcagaccgtgcagttaaaaaccggagagacagttcccgtaggagtcacatatgcacaatccctgaaaagggcattttctgattatatttcacgttttcacatttataattccaaaaattcaaattagaaaaaggagaggccatgttttacattgttgtcccggtagttctcctgtactactattcttttctgtattattaccgtaagctctttcctgtacaggggagacgatttatccagaccctgctgcctctgatggccattgccgcatcatatgtcttcctagacccctcggaaatgcgctggttaaggattccgatcatcatgttctccatgatcctggggatccgtttttccaccggaatggactggcttcagtctgtctacgggggaagctgctccgtgttaagcgcatactgcttccggggcatatttgcggtattcagcgcctttgctttccgcaactatgattggaccaatatagagatttactatggaagcaccgtcatgatccttcccttagcacttgtattctttgtaattctgtacaaaaccatccttcctgacgacaagcttaagctctttttatttaaccgcaatcagcttaaatatgtcgtggtatatgagattacagctgcactcaatctgactgtcataaattcaggacgcgacctgttcccttttgacttattgttttcaggcaatcttttatctccttacggcatatggtatgtggaagtaggtttaggagcttatgtcctcactatcggcatgctgatatatgccatataccagtccatccagagcacggagctgctggaataccagtggagaacagaaatgctggaagggcagtatgaacggcagatgcggcattataaatcatatcagaaatacacggaaagcttccaggcattcaagcatgattataaatccatgatggtatcattaaaatcattgatccggacaaacgaaaatgaaaaagctcttcagctgatcgatgacatatttgacgagatgcaaaaaaaggtacaggtccacaaaaaatattccgacaacgtcatattggatgccatgctgcaggatcttgcaaatatctgctcagaaaatcagatacggttttcgtcaagcgtattcgttccccgcgacacaggactgtcggtcattgacgccatccgtattttttcgaattttaccaacaatgccgtggaagcctgtctgaaagttccggtttcagagcgttttatcgatgttgccactaccagcgaacagcagtgggtcacgcttcaggcaatcaattcctatgatggtcaaacacgcgtggaaaacgggaaactccttacaaccaaaccggataagcacaatcatggactgggtcttagaatcgtagcgcaaatcgcagaagatttaggcggatttatgatgtatgaaacggatcctgaaaccaagatattcctggtaaggatccatatccccggttaagcgaaaaacagtctttataagttgatcagctttcatatttttatcaggacaaagcttaggttgtaaaagaacctcaggaagttgatatgctccaattataatttcaaatgccccggcaatttgccggggcattgactataataaaaacaagaaatcacaaatcagtttccgcaaggccaggatcaggtcgcatttatttcatcttctaatccagttgtgcagagagcacccatgtaaaaccatatttatccgtaacgcagccactcattccatgatcgtgaggaggcgggttttgctgcaatttatgaactccggctccttcttctgcaagaatattaagggcctgttctgccttctcaaccgaatcacaataaacatggatactgattgccgaacctttctccaccggccacattgcatctgcaccgctgacaccgtaagtttcagtcaacatgacatgcccgtgcatgatcttccttttttgtatttcatccataggccggtccggatcctccggcatctctccataccgggctaaaagcggctcctgtccgtcaaaagcccgttggtacagccgaaatgcttcttcgcagtccccggtaaaattaagatatggcataatcataatcattcccccatattattccgcgtatcttctatttttttacagccatttgttattctccggatttccttttccgttttaggattccccgtttataccgcctggcttccgctctttctttttgtactttttgcatgcatacattctgcggtccgcttcctggagtatatctgccaagcgataggcagtgccggagctaaaggaaaaagtgccgtggctgaatgacagcggataaggctttgatgacgagcattccagctttttcaactcactgcacattcttacaatgatcttttcagcaatatcttccctgcaattcctaaatataatgaaaaattcatcccctccataccggcagacaacatccgaacttcggatcgaactgaggatcactcctgcgatgctcttaatggtaaagtccccctcatcatgtccatatgtatcattgatcgctttcaaatcgtcaatatctataaatgtcagacaggttggcgtatcgttataaagcagggtcttttccaactccttcaacccagcctcccggttataggctcccgtcataagatcggtagccgcagtcagccatagccgatgctctctcgttttccagtcactgacatcctcaatcacatagaggaacaggacctgtccattgggcagcaaacacctgctggacatgatccggtaccatatgttattgctgctatcaaaaacttcacggaaagccggaaaaatgtcctgcttgccaagctccgccatcatctccaacaggaggctgctctgctcctgccgggaggatatatactcaacatcacctaaggtctgtcttgcaggacggttggcatataccactttcccattaaaatctacctccagcactaaaatatggaggagatcaagggcctgaagaatctgatgatagcgccagctgctgacaggcgcaggaatgtcccaggtattatccctctgtcttttacagaagcggacgccacccggtcgatcaaatcattaaacgtatcaaacaattctccggaatattccagtttgctgactacataaccttctttcagctgtttcacgctctgggtcaaaacagagagctgggagtggagctgcttaaggggagcagataagtaattgtaccgggacggaaggggcccatccagcttgcccttcgataaatcaaccgccaggcggttcatttcattgatatttggaatcaattgattgatccttccaataaacttctgccattccggcgcaaaggcatcttctttcattctatcgcactgctctcccgacagcagcttctcaaacaaatcctccactgcctcaagcattgtatggtcttcatggttcataccctgtctccttgtctctgcccatctcctgcttccctcttttccttatctccggctttcagccacaaaccggcaggtcctgtccccggtagaccagcagtcaatctctttgacttcaaactggtatccgctgtaggtctccagaatgcccgcaataaaaccctcgtcatagtcacatacggtctttccggaaattgggaggccggagcagtctaagtcttctgatactgtcaaagtgaatgaaagggagtccatatccaccttttcaatgcgcaggataccgattttcagctccttcagcttattcgttaagttggcgatgaagaaatcaaaatcgccggaaagatccagcacgttttttgccagctccttgccggccagatgcccggcagcccaatacaggcggctggcggtctcttcgtcatattcacgagccaaaacgtcttttaaggtatattgcagcagacggtagacaattaccggcatatcggagcccagatttttccttccttcatcaacattgccaaggctcttccaggtgaaatgagacggtttactttcataacgcataaaaattcctcctttaaatgttatatgacagaaacgctcacccgctatcttcccggtatgcttaaaacttgcagaccagtatttccacgaagccattaccggttctgagaaaacttctttaagaaaaaacacgtaattccctgtcggctttcagcaggcacagatgatggcatgatttctctgtagggaaaaggacatttttttcattttataatatcttccttttatttaaggataaaacgttacaaataggctttttaatgtcctgaataatgagcctttgcccataaaacctgcgtgttgcggtttatacgttctttttctaactgcaaacaaaaagacccatttttaactgatgttaaaaatgagtcttttttatgaaagcgggtgatgggaatcgaacccacgtatccagcttggaaggctggtgttctaccattgaactacacccgcaaggaattttcgaaaagatttcaaaagtgctttgaaaagcacaatgcccaaagccggaatcgaaccagcgacacgaggattttcagtcctctgctctaccaactgagctatctgggcctaatcatctgcaacacagatgattttacaagatttctttcctcttgtcaagctaagttttctaaattatgtcaaaaaatcataattcttaatgagatctttccaatactcatgacgggcagtaaatcagctgggcagcttatgggattccgttccacagcagctgtccgttttcaaaaatcactcctatccgccccgtatcctttagccaggaaagataggaacggacagtgctccccacaagtacatattgctcaaaggtcatttccagacaataggtattgaaaagctgctgcaagaccttttcaaagataaccggctctttacagatctcaaggatctgatccgctatttcatgaaccttgtcaatgttaatctgagccagcggggcaatgttgtccgttacttctgcgtgagcaggtacgaaaacctttgcttttaatgtcttcaccatttccagggtgtcaagataagcggatacatcatagataaatccgatctggtatttttccagtgtttccttgcttgataggcagtctgccaaataaaccacgtcatccatattccgaaagcctaccatatcaaagaaatgaccaggaaggcgaataatgctcatgcactttggaagaacagtttcagtaagatattctgaattgctttcctgcgccatgaggaatttgtgccgcaagtcctttggaggacacccgccatataaaaaagagggctcaaggagcgtatgatttgtaaagtcacattcaatacccggagcataaattttgcatcccgtttgattctgcaaatacttattgccgccaatatgatcagcattggaatgagtattatagattgctgtcagccgccagccattggcgtccagaatctgccggacttttcgccctgcatccttatcactcccactgtcaataaggcagacatctgtatcgttaagcttaacaatgccgatctttgcaggactttgaacataataactatttgcgctaacctgattcagctcgtacatctgagaaacctccaatcagtaaaaattctgttatgatgaattgtataaatccccttttatcaacttccattgatatcaaagaattataccatgccatccatagcagtataaccggctttagcctctttggcaacaaaagaaacacaaacagaatgagaaaggttctgccccagaaagttaccctttgcgggtaacgaccgagggcatcagcccggttacaggaaggggagtatgggatactcccggacaggccttcctttccgcagcgagatcttatctccttcctccacctttccgcagagcagaggactgttcacatcatataaagcggactttctctttactgcctccacgctgtcattggcataacaatacttgcacccggccagacaggtgtcataagttcccacctcaacgctttccaagcagccgcattccattctctggtttttatcctttctcctgcataccgggccgcccagtaactgttccgccataacgggatcaatgcagcttcccctggcaactcccacagagcttaaatctgttttttccgcacatgcttcgatcctgagcccgaaagttcctgcaatggcggccagctttccgcccagtttcttcatcccttcttcatccagttcttctgccgggattcccttcatgttgcgttccgttttaccatacttatccagaaagctgatgacaaccttttccccgctgccgcacacgccgtttgctatctcctcaaaggcccgcagatggtattcctccctgtaccggctgttaaggaatatgggatcatacctccagaccatgcgttcccttcctacctgttccgccgtttttttgaaaacatcgatcatatgctttttatccggcagtccaggctccacatctgccccatatccggtcagggtgaactggatataatacgggatatctcccaattcccggatccgttccatcattggctccgggtttttcgtccagaatacaatcagctccacctgcgcgggagaaaggtcgatccggctgatctggcggctgttcatggggtttttcacgtaaagaaacccttcttttaatctgttaaaaaaccagtccggataaaactgaggaatatccgtccgcctgctgacactgagtatcatctcattccgctcctgactcttcttagtaaaaccattatactacgccaaaggactgacttcaaccgccgtgaattatattctgtcaatcagatattcgcaatccgcttcgctgcttaatgaggttaaactccagaaaatacttcgcctggacggaaacaagttatttataaagtacaaaaggcagaacatcaaatattatcacatctttatatatattcataatttcataaatatttagtaattaataaattttcgcaaatttagtaattatttagaaatcttttaatctgtattgacgcggaaaatattaaaagtttagaaaaacatgtaacaggctggaataacttggcataatgtttcatcccccatctgggaattctgataaatgaaatgaagcagctttacatcagtgcccgcaataatacttcatcccatatttacatgagacagaaaagcagaattaatgattggaggattcccatgaagaacgaacccgtatttttaaccgacaaaaaccataacgtcattctggaagccatcaccggaacgcccaatgccgcacttcccgacagcttaaaaccttttgaaatattggagcccaatacttcagacggggccgcagaaaaacacgtgccggtcattgaaacaaacggaaatcatgtgaccgtaaaggtgggcagcgcattccatcccatgaccgaggatcacaacattgcctgggtctgtttacagtcaacggcaggaagcatcaccagagtgcctttaagcccggactgcgagccggtggcgtattttacactggaaaaaggagattctccaaaaaccgctttcgcctactgcaatctccatggattttggaaaacagaagcataacaaaaaagccttcccaaatcagggatggcttttttaatttcccttaagcaatgcttttattgtttcacaatgattcagtcagttttttacatcgcggtcgggcgaaccctgtaaaatgatttccgcgccattctcatggtatcgtatctttgcctccggatatccgggcacttctattttccagcctcttccgccgttaacgttgaccgaaatcctttcagtcttttttaaaacctccacctttatggcttccctgccattctcatctggtattaccgtttggaactcagccccttccctgatctgaaacagctttaataatgtcccatccgtataatcataatccggcttttcttcacaatttcctgctgccaaaaccgtgttttcccttaccatgaggggaagatggaaatagtcaaagatttccttatgccattttcctcctgctttcacctctcctgtcagataattggtccatgttccttccggcaaataataggaaacttctccatttcctttcaacaccggcgccaccagcagggaatccccagcatatactgcttatccagggtttcacatgtgaggtcttccggaaactcaagaaacatggggcgcatcatcgggattccttctttatgcgcttttactgcctggctgtaaagataaggcatcagggaacacttcagctttacaaacctcctcaatacatcactggcctcttcatcaaacagccacggaacccggtaagatgaggaaccatgcagtctgctgtgagaacttaaaaggccaaacgcacaccaccgcttatatacgtcagcggaagcagtttgttcaaacccgccgatatcatggctccaatagccatatcctccaagagataaggacaagcctccccttaaatcttctgccatggacggataggtggcggtgcagtcaccgccccagtgaacaggaaacttctgtcctcctgctgccgttgatcttgcaaaaaccagagccttatcttttcccagctttctttccagaagttcaaaaacagtcttattataaagataggtataataattatgcattttaaccgtatctgaaccatcgtaatatttcacgcccgtaaccggtatcctttccccaaaatcagttttaaagcagtccacacccatgtcaatgagcctttccagcttatcctgataccatttgcaggcccttgggttggtaaaatcgattaaagccatacctgcctgccaccggtcacactgccatatatcatcatcaagggtttttacgaaatatcccttttccagcccttcctcaaataatactgatttctgggcgatatagctgttgatccagacgcagatatgcagcccccgctctttgaaacgccttaacattccttccggatcagggaatgtatccttatcccactcaaagctgcaccattcataccctttcatccagaagcagtcaaaatggaaagtatgaagagggatatccctgtctgccatgccctggataaagccggtgacggttgcttcatcatagcttgttgtaaaagatgttgtcagccacagtccgaatgaccaggccgggggcaatgccggttttcccgtaagctccgtatacagctgcacggttcccttaggcgtctgtccattgagaatataataatccagtctctctgtctgtacactgaactgcacccgttctaccttctcgcttcccacttcaaaatgcacgtctccaggatgtcccacaaacaacccatagcctttattggtgatataaaagggaacgtttttataagtttgttccgaagccgttcctccatcctcattccagatttcaactgtctggccgttcttaataaacggagtataccgttctcccaggccgtaaacatattctcccacatccagaagcagctgttccaccatgtagttcttctttgtctcccggttctgcatataagcaaaattgcggtaaccgctttccgtcagcagccggtctccttctttgaattccaccttccagccgtttgcagatttatatatgactgcactggttcttcctgatgtatatgtgattttttcattatcctcagttatggatataaaatcacccttttgttccgccacctcataatggggtcctttataagctgctcccttaaaatgcacggcagatactttaatgacattttccatgggacttgaaaacgtcacggtgagcagcggctgattcagggtatccccacggtcccccatatgctttgttgcagcatatactgtcagctgatcacaattccgttcccactcataacattccactgcatagaccggatctatttcttccctgatccgccagtagccatttgtaaacttcacttcttatcccccttttcctgcccggtcaagcggatattcgcaatccgcttcgccacttgattcggttaaaaactgcggttatttcttgtaaataccggaagcctgtgaagaggagcatcagcttcgattgttctgccgccttccattgtttctcccgtccaatagtccttccatatactcccctttggcagatacacctttctatttctcatatctgcataaaggatgggagctacaagaacatccgggccaaacagatactcatcttccacctcccaggactgttgatcttccgggaaatcataaaagagagggcgcatgacaggagtgcctttccggtgggctgcctccatcaattccgcaatatatggtttcatacgattccttaactgcaaatacgtcctgcagatctcataggcttcctccccgaaagaccatacctcattatcagcgccggaaacacaagcagcaccgccttttgttcccattggctcttttaatggctcccggtagccgtgaagacgcataaccggacaaaacgtaccgtattcaaaccagcggatcaaaagttcctgaaacgccggatcctttggatttcctccatgaaatccgccgatatccgtagtccaccagggaattcctgcgatccccatgttaagccctgctgccagctgattcttaaggcttccaaagctggaatggatgtccccggaccagacaagagcgccgtatttctgagaacctgcccatgcgcagcgaagcagattaatgatattctcctgcccctccgctttcattccatcaaaaaaggtcttggcatacattgccggataaatatttccgatctgcacattaggccccaaataataacggtaattatcaaaatcgtaaacgctgtattccggttctgcttcatcaagccagaatatacggatacctttttcaaaatagtttttctttgccttttcccacacaaattcccttgcctttggattcgtggcgtcgaaatggactgtatttccctggaaatccattgcgatccggaatcctttgtccgtccggatcaggtatcccttttctttcatttcctgaaagttttcactgcggtaatctacggtgggccatatggataccataagccggatccccatctcctccaattcctttatcatggcatccgggtccggccagtaatttaaatcgaacttccaatctccctgcaatggccaatggaaataatcaatcacgatcacggatatgggaagctctctccttttatactcccttgcaacctccaaaagctcatcctgggtctgatatcgcagcttgcactgccagaacccatggcataatccggcatcatgggaaccgtccccgtaacttttgcataggactcttctatttttgcaggtgtatcctccgccgtgatccagtaatccagccccttggcagaataggcttcccaggttgtgatatttttgccgaaaatggctcttcccactgccggattgttccaaaggaagccataacccagagaggatatggcaaagggcacacttgcctgggagtttcgctgtgccagctctaagtccgtgcctttcaaattcagataaggctgttgatactggcccatgccgtatattttttcttccggctcggatacaaaacgcatggataaatgataatctcctccgggaatgggttttaattctcttgcctctacctccagggcactgcagtagccggcaaacacatccagccggttccttaaatattcgtcaagcagcacctcgcctctctgattgtaaaaagtcaattttccataccgggagattctggcctcaatttttccgttcttaatgccggcatagtccttttctattttgatctcaggcatgatggcctctgtttctacggacaatgcccagttttcttttggcatttcagccattttcgtggctctcacgcgaaagctgttatctccccatggctcgatccaaagctcttccgcatcgtaatggtatttcaggcagttattttcttttctgaaaacattcattttctttttctccttttaatcagctatccctttacggaaccgcttgtcatgccctctacaatatatctctgcatggtgacaaaaatcaggcagcttggcaaaataagaagcactccatatgccataatgctgttccactttgtgccatactggttcataaacgtatagatggccgatgtcatgggccgcatggtttcctttgtattaaaggtcatggagtatgccagatcgttccatgcaaaaacaaagctgaagcatgccgccgtaatcacagttggtttggaaatagggatcgctatgcgaaaaaaagcaccggccccgctgcagccatcgattttagcagcatcctccaactccgccggaatgcttaaaaaaccagggcggagcatcagcacgataaacggtatggatatggtagcagtggacaatatgggagctaaataggaatttaatatcccaagctttgaaaagatcaaaaataacggagtaagaaccagggaggcaggcagcatctgtgtgagcaaaaacaccagaacaaataatttcatcccttttacccggaacctggccagaccatatgcggcgggcaccgcaaggcacagggacaatatcatggaaccgcaggcaatgatcacggaatttttcattgttgtctgcagattccccagctgatcctcataagcccttaaggtaaattccctgggccacaaggtgggagtgcctgcaaagatttcactgtccagcttaaaggaattcacaacgatccagtaaaggggaaataaaaatacgcaggcgatcaatatggccgtcaggcataaaagtatattcttctgcttatatgtaacatggattttcttcaatacgtttctctcctttctgcgcggttttacacgtttatttaatttacataacttcttccctggaaatggttcttaaataaaccagcgcaacaaggaacaggcaaaggaacagcacattggcaacagcagcgccttccccaaagtgaaacagctgaaaggacagtttataggaataagtagacaaaacctctgtcgctgtgacaggtcctccgccggtcatcacatataccaggtcaaatactttaaaggtcagcacaaatcccaggaccagaaccgacatgatggtaggctttaacagcggtatggttatccgaaaaaacctctggatcccgctggccccgtcaatggacgctgcctcataaatatccccgggaatattattaagccccgtagtgagcaaaagcatgttgaaaggaatccccacccatgaattggcaatgatcagtccaagcattgcagtattccccctaagaagccatccaatgggccttttaatgatatgcaggctcatcaaaaccttattgatgatgccgttcccctctgcaaacatgaacttaaagaccagggctgtgactgtaaccggaagcatccagctgatcacgataaatcctctgatatattttgaaagcgtaaacttcctggcaaaaaaaacagcaaacagaaaaccaaatgaaaattgtatcaccaggcagccaaccgtatagaccagtgtgtgcaataatgattgccggaatgttgcttctgcaaaaacggccttataatttttaagaccaataaattccctcattttacttcccaaggtttttgcagtcacatcctgaaaactgatgatccagttataaacaatgggatacccgataaaaatcagcatgtaaataacagcaggcaatatcaggcagtatccaaacagcagctcctgtctctcccttctggtcaatttcatccgcgacttctccttcccttacttttatgtagaaaaggtctcaccacatcacaatggagcattgtacatgggatgagaccattccgcttatgtcttactgagcctttattttatcaatttttgcctgggcatcagccattgccgtatccacatccttctgaccggtaaagacttcctgctgggccgtataaatcgctgcagacatttccggccagtccggtgacggtcctcttgactgggcatccggcataacttctgcaaatacggaatttaaaggatcatcggcaaacatcacctggatatccacgtcagctcttggagaaaaccggcccattgccttacagatttcctgagatttctctttgcttgacatccaggtcaggaacttccaggatgcctctacattggcatccttgcagatggctaaattttctcctcccagcacggaggcataaacaccgtcatctgctttaggaacctttgataccctgtaatcaagtccgggggcatcctgttccagactggaaaactgccacggtccgttgatcatcatcgctgcctggcctgatgcaaactgcttctccgcatctgcctgggtccagttcacacactctctgcttatgtaacccttttcgatcaggccctgtaaaaatgtcatggatttcctggaaccttctgaagtaaggtctgtaacacttccgccggaagacaagagccacggcatatactggaaggtgccttcctcatttccgatggctgagatcgccagcccttttaccttatccgttgtcagcttttcgcaggccgcttccaattctgaccatgtagccggcacctctacgcctgcggcctttaacatctctctgttataaaaaagccccagacagttgttcccccatggaagaccgtagagtttcccctcgtaataacaggaattaatggaaccttccatgaaattcgcctctggccatgacttgtaaaggtcggttatgtcctcaaaaactcccatggaagcatatgaattgtggtccggattgtccaccataccgcaatccggcagctcccctgatacgacgccgatggtatactgcttcataagctcttctcttggaagatattgggccgttacataaatctcatcctgagaattgttaaactcctccacagcctgaaccacatattttccttctttatcctccgacatatagtgccagaacgtgatttcctgcctgccctctttagaagcttttccggtgcctggacttcccgtggtttctaaagccccgctgcttgccgcggcagacgtggtttcagtcggcacaggtgcttccgccttgtttgcacaagcagcaagcgtccccattgccatagcaagtgctgtaaatacagccaatctttttttcattgattacccctcctgtattctttatgtgtttagtataatcttcctgtaatcctaaaaaaatatcattatcttaagaaaagtgtagaaagttaaagtaacgccgggcaacaggaattattctcctgccggccggcgttcctcttttcggctgtctattgcaaactgctttgccgagactcccgtatattccttgaaaacctttgaaaaatacttttgatccgggtatccgactctgcatgcaatttcatagattttcatatctgtagccaatataagctcttttgccttttcgatcctgattctttttatgtaattggagaaggtcatgccggtttctctgccgaaaagattactgatgtattccggcgttaaccggaacttctcggaaaaagtatctaagccaatgcgcattccataattctcctccattgtggtgaccatttccctcaccaccctggaatactgccctgtttcaaaattacggggcggactttcttctttcctgtcccctaatttcaccaataactccttcacatcggatatcataaccggcttcagcaaataatcctttactccaaggcgcattcctctcctggcatattcaaattcagcataaccgctcaggattacaaaggtacatgatgcacctatgtttctcgccttttcaatcatctccagcccgtccattttcggcatgcggatatcagtgattacgatatcgcattccatatcctgaatcattttaagcccctcatatccgttttccgcttcccctatcacccggcagcccatgttgactttattaatcagattgctgagcccatgcctgatccgaaactcgtcttccacgataatgaccgttttcatttcccgtcttcgcttcctttctatccgtaaagctttccttcctgtttgtccggtatgattaaaataaactccgttccttctcctggtttgctcttcacaacaatatctgcttcatcctgataataaatgcgaagcctgtggaccacattgctgatgccgatgcttctgccgtttaaggctccttcttccgatatctcttttttaatttccgcaagagtctcgtctgccatgccgcatccattatcttttactctgatttccagctttccgtcttcccggataaatgctttcacatcaatcatgccgccttccttcacttcttcaaaggcatgcaggattatattctctatgatcggctgcaaaagcatcttatagatgggaaacaccattgcctcatttgtaatatcatattgacaatcaaaagaattctggaaacggtctctttgaagaaatatatatttttccagccagctgatttccgcctccagcatcaccatcatatcaatattggatacgctgtaccgtaaaagactccccaatgtaccaagcatattgctgatttcctcttcgtcatgttcaacagctctccaattaatggaatccagaatattatataaaaaatgagggtttatctgggcttccagagccttgatttccgcatgcttctggctgatggcagcggcttttatctcttcatttctctgtctcaaggtctctacaagggaattcacccgggcagtcatcttgttaaactgcctgacgattacgtacaattcatcttcttcattcaaatccgttatgatctgatccgcatctgttcccttaaagtcatggatattctgggcgatcttctgaatggctccaagatacctttttgatataaaaaacaatataacaaaaaagaggaaggtaattgccaccattaacaccagaacaatgcggataaaatgatagatctccttttgatagactgctgcatcaataatattcacaatcgtccattctgtgccctctatttttctccggttctctgaaatccccctcataccgccaaactctttatccaggtaatcctcatatctgccatttacataggccggtccaattcctgcaagaatcttatcactgccatccacaattaccgtggtgacaccgctgtcgcccccttttcctttttgatcctgtctgccgttatcaaataacagaacattgtcttccaaggctaccaccaggacaccgctttgttcctttgtccttaagttctttaccggatatcccatgagaatgacaaaatcatctttctgaggggagttgcttaagttcaccgtcgctataaacgtcagcttctggcgtttctcaatttcatcatggatcttctttctctgctccggctctgaccagatattttcattcatgcttccataccatttggaatatgtcacatatctgccgctgtccgccagaaacgtaatgctcctgatcccgtcatatgtgtaaacacagctacgaagcagcgtctccatatgggcactgtctatcagcagggaattttcatcctttgtattaatgtcttttgataattcaatatattcttttttagtaatgagttcatataaaacattttcataagcattcatcctctcctgtacaacgatttcatgcaatcgcgcattttgttccaccaggccataggcttcctttaaaaagcttctgtagtaaaggatactggctgacagggtaatgatgagaaggggaagaactgcaattaaaaggtatgctacaacaacctttctttgtatgcttgatttttttccaagaaaacgctccatatggactttcatacctatgtaatacctttcattggtcttctgattggctattctttacaaatatatcataactgattgataaatacagcatttatattaaaattctgattgccgggccgagcactctggcggaagttttttgattcacaggatgaaatttttccatgaatcaaaaaaacccatcccgtgtcgggataggccgttttaacattcttccggatcctccggctgttcctcattatcattatcttctggaggagcatattcttcaatcaatttgaattttgaaacctcctgatttaagatcctggcctgggcagccagttcttcactggaggaggagctttcctgggctgttgcggcattggcttgaaccacagccgatacctgggacaatccttctctgatctgttccatggcctgcgcctgatccagggaggccgattgaatttcctcgatcacctgctccaaaaggagtgatttttcagatacctccataaggatctctgccgtctcatcagtctgcttctttccctctgaaaccgcctttaccgtatgcccgatcagctgagccgtctgttttgccgcctccgcagatttcgccgacaagttcctcacctctccggccacaaccgcaaatcccctgcctgcatcccctgcacgggcagcctccacggcagcgtttaaagccagaatattggtctgaaacgcaatatcttcgatcatctttgtgatcccggatatcttttcagaaaacatgcttacctcattcatggcctcattcaaactttccatatgccggttaccatcattgacccttgccccggactgatttacataatccgaagcccttttcacatgctccgtattttttacagccttttctgaaacatttgcaatggaaatattcaattcttccacggtttctgcctgcaaggctgctcctgaggcaagagcctgggaaacgctggaaacctgtccggcaccgtaatccacttcctgggcggaggcactgatgtttagtatggtatcatttaagcgggaagcgatcatttccatggaactgcgaatgccgtcaaattcaccaggatattggcaatcgctttggaccactaagtttccgcaggaaacctcctggagaaaccgggaaatatcgctgatgatatccctgtattttcccgccatttcattgaccttttccccgattcccccgatttcatcccgacgctccatgtgaagctctatgcccagatcaccggcagataacttatcaatagaatccaccacctgcccgatgggttttgtgatccggttggtgatccgaagcatgatgaaaaccgcgatgatcatagagacaagccccaaaataacggagcttagcatggaggctttgaccccggacatgaattccgattccgaggccgtcacatttaccgaccagccattggtatctttcacaggagtataggagccaaacttactttccccgttccaatcatagaaatcaaagccggtttctccctttaccattgcagtttccagctttgcgatctctccatatacagcctgatctgtttttgctgcctccatatcattttgctgcgccagcaccagagaaaagtcctcgtgagccactttcgtgccttcccggttcaggatataggtgcttcccgtatccccaagctttgtatccgcgataattgtttcaaaaacagaataaggaaattccagcataatgatcaggtcgtcatagggatacgcatattcaaaggacacggactctttatggatcacagggtctgacaaaaaaggggttccgttttttgcctgcaagtatgcaatgtcctgttcataggactttccgttgacagcagacaacccgtcagacgaaatgatatcgatatttttaagaccatactgggaacatgcgattcgcaggaatatattgatgttgccccctttttgcacatttcctttcatatacagggcaattgcctcggatatgatggaatactcctttagctgctgggttattttctcagaaaccagctctgaagtttcctttaagctttttgccagggacttttgtgtcgtatcataagtcagataaatggagcctgcggacagcacgaatacaatggaaatgatacacgccattgtgaatgtcaccaattccttttttattcccttgtgtttccctttcatatttcgttatcctccgatatccagtttacgcctccgttgtcagactttacggaggctcaatgtgtatatcggccaatatttagataactatatgcattttaccaatattttacaataacttgttcaaacttttacagatgcacaaaaaattaacaaaaaaacaagtacgctaaaagtcacaatgcattcttttcttttccagagcggtaaatatccaaaaccagcttcaaggttttctttgcgtcttccggatccgtggggacctttcttccctcttccagacaccggtaaaaatcacgaagctggacttcatgataatttccccagtaagcctcgccctgaacatccggtccggccgccggatacacagtcctttccggtctccccttcagcttaatgaggacttcattctgggtcagcagtgcggtaccgttttcaccgctgatctccacacggatggcactgttgcttgtgtaataattgcatgcaaaaaaagaatatacggcgccattttcaaagacaatggctgcatccgccacatcttccacctcaatatttgtcagaacccggcggtcgatgcttgcattcacctttacgggctcgcatcccatgagataacggaccagatccaggctgtgaatggcctgatcaataacaacgccgccgccttctctttcccagcttcctttccagtcgcaatcgtaataggacggcggccgccaccagttcaacgtggaaaaggcgccggtcagtctgccgaattcccccgcctctatcaggcgttttacttcccgtatcccttcaatataccggttctggaatatgacccccagctgcttatgattcctttttgctgcctctgtcataaggtccgcatcccctaaatggatggcaatgggtttttccgtaagcacgtgaaagcctgcatttaagcaggcaattgcatgttccttatgcaggtaatggggcgtcagaacatggaccgcatccagctcctgctccagtaagtcctccagcctgtccgaaaaaccgcatcccggaaatcttccggcaaagttctttgcccgctccaattctttatccaccgcaaagcagacttctatctcttccatatttttaaatgccgcagtataaacagaagagattctgccgcagccgattaccccgattctccatgtcttcattttgtcaccccttaataaacaattccttgattgctaaagcggcaccgccccttgcgcctataaacggatcaaaatcaataaattcaaagtcaatttcctgctcattcagtgcaaaaatgtgttttctcgtttcttccagaagctggcgcctgttcctgttaagcttcataatatagccgtcaatgatgacaaggggaggactgatgagattgatgatattggccagcgcgattccaagatatacaattgcctcctccattaccttaatcacatactcatcaaagcattcctgggcggtcaggacctctttcatggtcaggaggtcaatatccgggcaaagctccgccagcatggaggctgtgcccgcttttatatctgccttgcaccgctttattatggccctctcacttgccacctcttccagacacccgtaatgcccgcaggtatcgcatttgggcccgttcatattcactaccatatgccctgcctcgcctgccatggaattggaaccggtgatcatacggctttttacaaacatggggcacgcaattccataagaaatcagataataggcaaagctttccggccgcagggtcttgctcagcagttcctccccgatcacccgtaccctggcattgttttcgatcagaacagggatttccattcttttggataagtcacgcacaatatttttgttgttccattctatgttaaagctctccctcaaaacgcctgcatggtattccacgaaacccggcagtccgatcccgattcccaaaatgcggtcagtgtccactccgctttcatggatgagcttatgaatcctcttcgccagcaaatccagctctgtctcatagccggctttgcgcggctcatagcgggcgctgcagatttcatttccccgcagatccagcatgcagatggccgtatgataggggtttgtctctaccccaatggcatatctggaggtttgaataaaatcgatcttcaccgggcggcggcccaggggtctttcctcacattcggaatcttccgcagaaaattcgtgaatcagcccctgttcaatgagggatgcaacattggtggttatggtcggcggagtcagagacagcatttccgcgatcctgcttctggatatggggccatatttatagatgatttcctttataagcgtttcattttgttttttaactctaggaagattatttccacggacagccacgattctctcctccactctgcttttatgtatcttctattatagcggaaaagtccgcatattaccagcagaggatgccgttttctctgcaccctctgcctttttcctgtattttcttctgttttacttcagttctttataatccgcttccgtgtaatcttttaacggatcccagttggggaaatcaaatacgccaaagtcaaggccgattgcctgggaagctctcttccactcagcggtggatctttcagacagctgtttcaattcggcggtataatccgtgatgctctgagccagaacaccctgggtgattgcgcccagactgggctgcacatcctttacctccgtatagaaatcatagaccttctcatcccgcgcggtggcttccggcacgtctttggcctgggcggaagcgacttcgtaatactccttcatcacttcgttagacatatgcttttcgttcacgctgggaatgacggaaacgtaattgccgtctgaaacacagccggactgataaccgcctccctcactgaacaatgccatcagatattcagccgcttcctttggatgttttgactgcttataaattcccatccatggagccagctcaacctgctgaactccgccttttgctccgccgtcaggcacgggaaccgccataacaccgtaattcaaatccggatacgcctgttcccagggcgggatgcaccacattccctggcagataaagcccgcctgcccctgtgcgaacaattccctcgcttccggcgcactgatatttacggtatccggatgaacgcttccatccgccaccagctgttccagcagggccatggcggagatcactgcctcgctgtcatagggcgcctttccgtcaaccgtaagcaccttggaatatggagcgatcttaccgcctccaaccgctgcgaaggaacggaccagcgtatccagccggttcagctgctttccgccttcgaccagcccatagacctggccgccgccggtttccgttatctttttgcatgcctcaataaattccccataggtctccggaactttattcaccccggcatttttcagcacatctttattgtagaaaaacagacagtttacaaccggcatgatttctgaaatggtataccactggtccccctttatggtaatgccttccttgactgcagcagggtcgacactgtccttgaattcctgggttatgtaatcgtccatgggctgataccattcttcctttaaggccgtgcttaaggtcatgcctgccggaataggaaacagatccggcccatcccctgattttatcattgtcacaatcgtatttttaaactggtctacggtcagcatcgtatattcgatctgaatgtcaggatgttcctccatgtactttttgttaaattcttcccttcgctttaaagagctgtcactccagtccacaactcttatggtgatctgttctttccccgctttctctccggcttcctccgcctgtgcagctgtctcttcctttgacgccgcggttgtccccctcctcccgtttttggcattgcacatccggtcaaaacatgtgctgtcatgaccagggccagcgaaagggcccctgccttttttaatttcataaaccactcctcctttatttattatattttcagggaatgctgctgccttttccctttttaccgccgcctaactttttaccgctccggcaattccttctacaaaataacgctgtaaaaaaataaataatacaataatcggtatgaccgcaatggttcctcccgcagcaatgccggtccagtccaccgtattttctccccggaaggcatacagtcccaccgccaatgtacgggaagcaggattgtttaaggtcagtaccagaggaagcataaatgcgttccaggtccatatggtctccatgatgacgaccgtcgttgcaatcggacgggacaggggcatcataatgtggaagaacgtttcaaaaaaattacatccatccgcccttgcggcatcttccagctcccccggaacctgtttgaaaaagctggagaacagaagcagaaaaataacgtgggcgccgcctgcctgtgccagaatcagccccagccttgtgcctaccagattcaggcttttgacaacttcataggtaggtataatggtactgactatgggaatggcaatgctgcttaaaaatacggccatgatcacctttttcccgataaaatcatatcttcccagggcatatccggaaagcatggtcatgaccagcaccagcaataccacaaagaccgtaacagtcaccgtattgaaaaaataagtttcgaaattggctttctcccagatcctcagcacgttgtcaaaggtgggctccttgggaatcagtcccagcctgttgtcaaagaattccttctgacttttaaaggaggctgaaatcatccataaaaacggataaatccaggccagcccaatcaccagtaatattacatgtgtaagcaacgtctttccattgcggatccttctctctctgctcatctttaccacctcccgattcactgcatccgtctttggttcagccggtctttgatcacattagacaccgtaccgatggcaatgaccgccccgccgaagagcagggccgccgcgctggaatatcccagcctgggcattcccacttcgctggaaaaagccatacggtaaacgtaggttgctattacatccgttgcataaaacggtcctccctctgtcatcgtctttatcatatcaaataccttcagggaattgatggcacagaggattgctatcacgcctcccaccggtgcgatcattggaaggacaatatggaaaaaaacctgccctctgcccgcgccatccacggttgcagcctcatacacatctttcgggactccctgcagaccggccagccagtatatcatgtatgttccgcagtccttccaaagcgagatgaccaccagtgccggcattgcgaacttcgcatttcccaggaaattgaccggtgtcctgcttatatgtaatgccaccagcagatggttcacaggcccctggacgcctagcaggaatatcataataattccaacaacggaagcagtggtgaccacaggaataaaatacatggtccggtaaaccgtacgcccccttaaccgttcgttgttcagcatgtaagcgagaaacagggaaactgccagctccagcggcacgatcatggccgtatacttgaaactgttaaaaaatgcattccagaacagtttgtcatggatcagttccacataattctgaaggccgataaacaccgcgttatgggtcaatcctgaccagtcgagaaatgaatactgtatgctgcagataatgggatatccctggaacaggatataaaaaatcaatgacagggacataaacagccagcaccatccattcagaataattgcttctttccgcttatttcttttcctgaccgcagacacttcccttccccccgcattcttttccataaggcacctcttttccccaaatttatagttgtatttaattttttaatttaattaatattatatctatgtgtataattattgtcaatatatttcttttttttgtgcttttttcacaaatccttaacgtgaaaaatcctgcagaatcattactcatgatgattctgcaggatttcttccagctgattggtcactccaatcatggtatagtatgaggtctacttaaggccgcgcacatactgaaacagaagtccctgtttgatgccgcctcttattttttcttttacatccttttcgtggtctttgggacagatattcttcacctttgcccagagcatttcatgggtaaaccggtcatccggcttgtgaggcaccacatcgcaggtccgctgataccaccgcatcagttcaagccggagcctggaaatttgcggggagtagtccgggttatgtatctgattggaggtttctcccggatctgcttccagatcatagaactcatcctcccctgtgatcctgctgatgtatttgtacttctcactccggatcatggttcccttggcatgggcgtcatcatctgtctgcgccatcattttgggccagtatacaaaatcccggggcggaccttccgggccggaggcatgatattcgtcacaatggaattcccccggcagccttcctccttcacaaaagacatactcccggtttttcacgccgcggttttccaggaccggccgtaagctcctgccaaactgtgtacgttccggcttcaccccagcatagtccatggcagtcccatagaaatcaatcagttcggccattgactccgtgacaccggggtccaccccgccttttgggggctttaccagaagagggaccctggtcaggcaatcttcaaagcagctctgcgccttttccgtcagtccgtaatctccctcaaaatctccgtgatcactgaaaaagaagatcagacagtcgtcataaattcctttttctttcagcccgtcacataatcggtgaaattgtgcgtcaaccttcatgcacattcccagatataccgctctaagctcctgccagtcctcttccgtatattcatccatccgctggtacccacggattaaatctgccattctggatttgccggtacaatcctccggccggatcctttccggcagcttactccggtcaactgccgaataataaggttcttccacctgatacggcgtatggggaaaattaaggcccaaaaacatgcagacaggcttttctccgccatatgcgtttaaatgccggattgccgcgtccaccccttcatcgtccccattataatttctgccatcctcagccagctttaaacgcccctcaaaatgggagtacttatctttctccccttttttgtcacactccgggccagggggcgccggaatatctccgccgtaaaaaatttcatctgcatttgactccgcccagcccgggacctggcctgcaaacaaatcatttctcgcgttcatccagatatgatatccggcttcctttaattcggaaaacagattctcttcccccggatggagtaaataactcatcgtccggtgtccgtggacatgaggatacagccctgtaaaaaagctgcatcggctgggcacgcacaccggattctggcagaaggcataacggaaagacactgcctcctcttttgcaaaccgatccagaaacggagtcaccgctgcaggatttcccatatgccccatcccgtcatagcgcatctcatcgggattaaatataatgatatgcggccttttttccataaagcatctccttcccggtcaaccctgctgttttccttttcccaatgctgcaaacatgcttcgtttatactcctccaccccttcctgatcaaagggattgacacccatcagggtaccggacaccgcgcatgccgccataaagtaataaaacagttctccaaagctttcttccgatatttcatttactatcagacggatgcagggcactccgccgtccccatgagcttcccaggtcgctttttcagccgccttgttgatctggtcaaagtccatgccatccagatagtcaaatgcatctccaaattcccggtccggttcgatgaccgcactggctttcggatccttgaccgacaaaaaggtttccagaaggttccgccttccctcctgcatgtattgacccatggaatgaagatcctcggaatagatcgccgcggccgggaatattccctttttctcctttccttcgctttctccgaaaagctgtacccaccacttggttaaaaatgcatactggggttcaaaggaaaccagcatttcaatgtcatagccattctggtacaggatgtttctggctgccccatattttaccgccgggttggtagcgggattgtttctgcagtcttccatggcatatctcacccctgccagaaaagcatctacgtcaagaccggctgccgtaatggggaagagacaaaccggggagaatgcggaatatcttccgccgacggaagccggaaactgcaaaaacagatatccgttctcctctgcaatctcttccagcctggatcccggcgttcccgtcagtatgatccgttctgccatttccgcctttgaataccgttttttcatccattggcgcagaatccggaaatggcttcccggttccagggtttcaaaattctttgctatcacatttatgtagacgctcttcccttccatccgctccagcatatggctgatgtaacagggggacagagtatttccaagataaatgatctccggtcccttccggccggccaccgcctcgatcatggctctcgccgcctgattggagcctcctaccccgacaatgacaaatacatccccgtggtttctgacttcttctgccttcgccttcagcacatccagctgaacagccgaggtttccagagtccgccagcccagcacctgttccctgtcttccttttcaagaagccggcttaaaatttctgaagcaatgcgctcattctcctcccatgcgttttttgaaacgtaatccgttatgtggtttatctcgattccaatgctcatttccggcctcctgtgctgctcttaaaatcgggtgtcccaggttccgcaccagacgtcatcatcgtaccggccttcaaactccgccagtcctgcaatgcgcctgatggtttcatcaatggtctccgggcggttgttataagcattgataaagcccggcactctggaaacatcgattaaatggttggtatagttaaaggatacaaatacagtgggaacatcgtgtatgtaccaggggtaacagctggacatgggatccggccacatgagacggactgaattcgtctgtgcaaagccgctgatatcggcaaacagcatcactgcgtcatatctcgccttaaaatccctgatcttccccttttccatggaagattccatcagctccggttcatatccgtaccgcaccaatgtttccagaacatgggaggcggtgtcttcacttccgccggactggactccctgaccataaatgctcttctggtgtcccacattccctgacagcacgaatactccgatctttttatagatatcaggcttaaaaggcagctgtccctttgtgttcttgaccagtgtgaccgcctttgccgccgcctttctggctatggcagtatgttcctcacatgcaatgtaggataaagcttcttttcccggccggaaaccttccccggctttcctcttatgcagtccgatggccgccttacaggcgagaatccggtataaagcatccttcagccgttcttccgtaataattcctgaacggattccttcctccatggcactgtaatcttcttccatatcgttaatgcccagtaccatatcacagccgcaggctatggtccatgggatggctttcatgcggctcataccgtaaaatcccatcatttttgtctggtccgtcaccgccagaccgttgaatcccagcttctgccggagcagtccgtccaccagttccttggaaaggcaggcaggctgcatatccttttcctcaagatccggattcagccctttttcataagccggcagtgtaaaatgggccaccataatgctgagaaggccattgtcaatggaggtctgataaatctttccaaaggtttcatcccactctttacaggataatccgttattgcccacagccagatgctggtcccgctcctcccagccgtctcctggaaaatgcttcaggcatggaatgactccgtattccatgcagcctttgttgtaggcctccacacactggctgacaaagtccgcgtcgctgccgaatgcccttgtattgatcaggctgttcctccagttcatcagaacatcccccaccgggccaaaggtccagttatagcctactgcagcagtttcttttcccgtaatgcgccccacttcgtaggcagcttccgggtctcttaaagccctgacctgggccccggaagcgacaagggtgccgcctcttaagactccgttaggtcctgattcacagtttcccgcataaagataagggatcctggagctttcctgcagctcagccataatgtcctgggcttcctcattgccaaacagcgcagcccggaagggaattcctgcaatgggatactgtctgagaaatgcagccagctcttccctgctttttcccatgaggggatctgcaaacagctgacagatcttttcgtgcatgctcatggaatttatcgtatcttctacccagcacgcaccttcttcatccaggtaaaagggatttgcttttatatcgaccatatgtatgtcctttcttccgccaacgtatcaaacagccgggcagcaaagctgttttaaatagctgaccgcatttgtgtagcgttcaaagctcacctcgcccttttcatattcaatcactgcccagccgtcatccggcatgctggccttcagtgtttccataagctcctttaaatttacgtcacctgttccaaggtccgcgtagctgttctgtttttcctcatgggtagagcacttttccatctccggccgtttaaagtccctgatatggacgtaagaatagcgggagggatgatcctttatcatggaaaccggctgccagccggcggataatgcccagccggtatccagggcaagcttcatttccggagcatgtgcaaggaatgaccgatacaaaaggccgtcgttttcaaattcccagtcatggttatggtagtggatctgcacgccctgctcctttgccctgcgggccagctcattgagcttgcaggccattttcttccccaattccggatccgacagccggctgtcagcctctttcccggctcctgtttctcccggcatactctttactccggtcagtatgatattcctgttgggcatgatccggagaaaatttacagctttctgaatattaacccacacttcctccggccggtccagcagatccgttaaaaggcatactgcatgaaggcccgaaagctccagctcatggatttcgagctgctgctttaattcccggcttctgtcaactccaaaaaagcgtgaaccgacttcaattccctgacatccggttgatttaaggcctgataaaacggtttccgtatcattggcgatccggtcggtaaataataccgcatggcatcctattttcattttttctgctcctttcactgaaaatcaatgggcacactgcagcctgtttttgaggattcccaaagcgcatcgatcagtctctggatataaatcccccgggaaaaatcagtggcagccggaactcctttttcaattgcgtcaataaagttccgcatttcaaaataaaaattaacagcaaatccttctttgggaacgtaatcatttatcagatacagtccttccggtactttaacggtttccggcgattccctatagcctccatccgggtccttcttctgaatccgcagggaaaaagggtcacttccgtcaaaaaacgcgctgccgccgcttccgtatacttctgttgtatgtctgcttccgacccggcttgccgtataggaaagcagcacccctttttcagtctttgcggaaaaagatgcaatatcgtcgttatcaacgattccggttccattgccgtttacgcggtccctttcctttaagcacgtgacactcatgcactgcagctccgtaatcggcccggccgtatcacggagcagcatatctccgatatccagcatatgacttccgaaatctgccatggctcccggccctgacagtgccttctgcatcctccattccagctttaccctgggatcggcgatcctgctgcctcccagtgactgccggacatagaagatatctcccagcgccccctcgtcaatcagctgctttaaatacatataggcgggaattccccggtaacagagcccgatcatgcaaaccttccctgagctttccgcataggaaagtgccggctcacattccctggcattggtgccgaagggtttttcacacaatacatgcttccccgcctttaacgcctggatggccagttccacatgatatgcattgggggtgcagagactgactgcatccacctctgaaagaagctcttcatagcttctgcaggcttttgcctcttccagctgaaacttgtctgtatattcctgtgaacgctcctgtataatatcgtatacagcggtaattttcgcttccggtatccgcagatatccctgaatatgcattcccgcgattccaatggtatttcctgccccaacaattcctacacgcaccataaatcatttcctccttataaatattgttttaaacagccggctcccaaaaccagcccgttaagtacttcctccagactcccctcataggacggatcctcatgttccaggcttatggtcttttcatatccagcttcctttaaggcatttatgagccgcttccagtcaagctgcccatggccggggatccggtaacaccaccagctgaagtcagtgagaatgccgcactcttttaatcgttcttcatcaatctccgtatcctttgcatgaacatggaatattttgctgccaaattcctgaatcggagcatagggatcaataaactgccataccagatgggaaggatcataggccaatcccaccttttggctgtccagttttttaaatatttcacgccacatcacaggggatatggcaatatttcccatgaggggacagttttcaaatgccagtttcacctttcttttttccgcaagatccacaatcgggtcaaaggtctttacaaaacgctccaggcttctgatgggggttcttcgaatggaatccgccttatcataaattccctcttccagggttttgtcaattccggtagacgtaacgatcttttcaattcccaaagctcccgcaaactcgatcctttttttcagttctgcaagatgcgcgcctgcctcttcctcatccgtgcttaaaaaatttctgcaataggtaagagaagtaattcctacagctcccttttccattacctgttcaaatttatcccgttccatgggcaccgtaggccctacttccagatcctgaaatccacgggcttctgcccaggcagcaatttcatccaaatgcttcattccctgtttcaccagaacattggtcataaaacccagcttcatttcttccctcctacttatttaattattttaattaattatatattatattccggctcttcaaatgtcaattatttcttcttatttttccgtaatgatcttcaaaaatgcagcagcaaggatgccgatatgctcagcatccctcccgcgtttgatttacatatccgctttcagcccgtaacgctcatacacctcgtccggcgcctcattctccttgaacagctgtgccatggcaccaagcatccggctctttaccgcatcctcctgaatcgggtgctcctgttcttcatctactgcaagatcatacagaacatcttctttcagctttcccagaagtcttaaggtattgccggcgggtatcttcaggagcggacattttttcgtgaacccaaagggcggagccagctctgccttctccatctcttccggcgaaaacagggaatccatatgagttggcatcagtgtatattcattcatgcagatattctcgttctgcacggcacgcatatacacatactgtccgtccgtgatattcacaggccctccgtgatagccaaatattccatagctgcgcaccttccggtcctcagccactgttcggcgcagtgatctaccggtcatatccttcgggatctccaatccaaagaaatccagaagtgtgggggcaatgtcaatggtctgaaccagggcctggcgccgctcccctctctttttgcttcccggatcccagatgaacaggggcgtgtggaccagttcttcaaagtcgggcatgctgcccttcccccaccatccgtggtcatttaacagaaaaccgtgatccgtgtttacgatcagcatggtatccgcccagaggtcctgtctgtctatttcatccagaaccagcccaaggcagtggtcacagtattctgccagtgagaaatactttttcctcatattttcaacggtttcttcatcctcagatacgggagaatagggcggccagtccggcaggaatggctgatccggatcaaaccattttccttcaaaatcctttggcgatgtaaatggctcatggggatcaaaggtctctatctgcaaaaaccagttgccgtgttttccattgcgctttatgaaatcaattccgtcggcaaatgtctgtgcctggggtaatggctttcatcctttaacacggaacggtttgcaaagtttctccatccgcccctttggcgccgcctttttatcatttccggtgtattctcatttaagagcacatagggagactgttcctctcctctcggcgtgcagtccccgatccacgcatcgctttcctgcccccggtaacaggcccaggaggaatagcgtccgcagtaagtcgctcctccatcctgtatgtaatggtaatggtccgtggctaaatgagaatggatccccgccttttgaagcagctccggcatggagtcgtcaaaaggttctaccggtccccagcttctgtgcagaaaatttgctctgccggtatgcagctctctccgcgcaggcatgcacggaaggctgcagacatagcttttatcaaaggtaaccgtatgcccggccagccgcttaaaattcggcagatccatgggatcaggcccctcgtagcagggaagcagatcccggcgcagggaatcatacataaccataatcgctttcattttgattctctcctttctctctccggtctcttatgctgattcctgaagcaccgtacgttctctgcgggtattctgcgccagatggatcctcgcccgcttttctctggcataatcaaaccggtaggcattcatacggtaaacgtttaacagcagaaataagctgtaaataatgatgttctgcatactgctgtccattgcaagcttggataaacacatggtcagtatcttgacgcttaaggatccaagaagtatccctaccaccggtctctggcaataggaaccgatcaataagcccagcgccatgggaaacatgtttttgaatacctgggtattgctggtcatgcccatgaccggtgtgagcccgccggtatacgcagtgtcaaacactcccgcgcatgcgaccagggcgccggccagcacatagcataaaatacagtttgtataaatatttatcccgctgtccgccgccagcttctggtttccctggatggcacggcgcttatatccaaatccgctgtattggaacaggtatgtgacacctcccaccaatgcgagggcaaccaccaggataaatcctatattagataatatctccacacccggctttgcaaacagcttcagtccctgctgggagtatgcgccgaaggaaaggcattcaaataccaggctgacgcctagtccaagcaccatgggcagtatgcgcaaatgaacgaaaagcacgcctacaagcaaaccgcaaagtgcaccggtgagcatgctgagaatcaggacccccacgcctccaaaccccaggctgagcgccatatttcctccaaatatacagcccatgtacatctgtgccccggcggataaatccatccgcccgctggttaagttgcagttaatggcaagggcaaagctgaaggaggtcagcagggtacgcagcagcgcctttacatccgcaatattggaaacaactcccgtgcctgccgccgcccggtcgatcagctcgcagaccagccatgttataaacggaattgccagggtttttaataagggtatcatttttaatgatctgatgttgcttttcatggtttcctctccttttgccagaaaggcatttcctatttgtctccaagtcttatcagtgtggattcgtaagtaatggaatccacgatggactggatatcaccattggtaatgtccggatggtaaattcccagcatgctgtcgatgatgttatatcccacaatccacttgtctccctttggaacatcccatttgcttgcaatatccaggtcttccagttttgtaataggccataagctggaatttaacataccggcatctccgttgggcgcaagagttgcgctctcgtatccggtgagaaggttatacgcctggctgaatccggccgcacacagaaggcttaccggtttcacggttgccatgttgatggtcgggtttccaaactgatcctttgttttgaatgcggtatgcaaagattccgcaatggttgccacgcctgccaccttgatatcttttccaatggctgcttctgtttcctgaacgatgacgccggtctggtcatataactggacggactgcagcataacgccgtatttacccgtctgaagagctgccgtcagcccctggagatagccttccacacgtgtcacatggccgggataaacatatatattgattcctttgtcattgacggcctcaatgggggcacttgaggtgaccagagcatcaaagtcctcttcataggtcaggccatacagttccgaaagggactttaaacaggcctgggtgatttccgtctgctgcaggtttccggtatacgccagaccgctgcatattaaaaagccttcgctgccatcctcactggcattttccttcagccagtcgctgaacacttccgcgatggcagtctggttggagccaaaggccgcaaaattatcataaccgcctgcaaaagccgcctcagttttcggattaatgcgtaccgtattcacgatatatttcattccgtattcctgacacacctgagtcatctgttcaatatcatcattgttatagctgatcaccgcatcacaaccggcatctgcacagttttcgataaacgtcaaaagcttttccgtatcagagacctgttcggagaacacaaattccacattataccggggtgccacatagtcttcaaaataggaacgtctctgaatgctttcatcattggcctgaacctctgcaacaccgattttaaacttcttaaaatcctggggcgtctttcccgctgcttctgaagcttcattgccttcccctttctgtgtggcagcctgggattctgccgccggttcatttttaggggttcccccgctgcatgctgtcaggccgaatgcaaggccgcacgccagtaacgctgcaaaaaattttttcataattttttcctccatttttatttatgaatcaaaactgctggcgggacggtaaggttgccggccgctcactgtttaaaaataccagaagcaggaatataagacctcttactccctgtattacggtgctggagacccccagcatcaaaagccccttgtttaaggcggaaaccgtcaacgcaccgataattccggaatagctgtttgatttcgcgcctccgaaaatggacattccgccaagaaccgttgcaagcattacatccatccccatgccgtttccagttgaattgcccacgctcccggttctgataatggtaaataccgccgcgattcccactccgatccctgccatcagaaagctgacgtaggtggcgcgggtggggttcatgccggtttgctccgcacatttttcatttccgccgatgaaccgaagctgccggccgatcttcgtataatggaaaaccagcaggcaaaccacaaaataggtcagaaaagccccatagcggaagcctccggtttccagaaccttgcataccttaaaatccaccttcagggtatcggctcccaccacctcactgatgatggcgttataaagctgcatcaccacaattgccaccatggttgtcttgatatgaaagaccacgcttaaggtacagttaaacatcatcagaaatacacagacgatgaccgcagcagcgatcataaggacaacacttgccgtgacgccgtaaaccagggcgcctgccacggctccaagccccatgacggaccccaccgagatatccagatttccggtcgtataaataaaggaaaccgcggttgccatggtgccaatgatcagcgcctggtcaaacacccctttgagcacgcttcctttcacaaactggccttcggtcgccatttcaaatgcaaagacaatcaggagcagaatggtaagcggaaataccagagtgaacatgcgtttattcttaatcatatcaatgcggtcattaaaatgtagccggggtgcctcttttacagctgccatgtcagtcattttactctcctccttaaatcatgcattcgatcagctggtgttcctggaatccatccctgcggaaaaattcaccgttcaccatcccgtccttcataatcagcaggcggtctgccataccgatcagctccggcatttcctcggaaatcatgacaatggatttccccttctttttcatgtcataaatcagctggtacatggaggccttaaccccgatgtccacccctcttgtggggcagtccaggatcagtacatccgcatcgtccgcgatccattttccgaacacgaccttttgcttatttccgccggacatggcccggaccggctgccagatatttacgcacttgatagccagctcatccaccaccagctgcacatacttctgctctttctttccggatataaacggtcccaacagacggttcttcttataacccacgctctggatattcgctccgatggacgcattcagctccagggattcctggtcacggttcttggatacatatcccataccgttgttaaatgcgacctccgcattcctgacaaccacatctttttctgtcagcacgactttgccatccacaacctcatcaagaccgtaaagagcccggcccaggccgtgcatcccgcaggcagacagacctccgatcccaaggatctctcccttgtgcagttccagatcaaagcagagaagatccttcatggtcgtgatgcagtccgccttcagcacgacctggctgccgtatccgtccatatcattccggtaatagtcttccctgacctcccggcccaccatcttgcgtttgatattccccggctcaaaatccgctttctccaggttgtcaatgatgacaccatcccgcaggatcgtaagtgtatcacaatgctccatcagctcatgaaggtcatgactgataaagataaccgctttgtttctggctgcggcatcatgcatgatctgatacagcagtgctctgccgctgtgagaaagagcggtggtggtttcatccacaatgaacagctccggctcccctgccatcaccctggcaatttctatgagctttctttcctgcatatcatagcggaacgccggctgggaaggatcaatcgttgtgattcccacgcgttccatggcttctgcggctgcaccattcatcctggcacggtcaatgagcggtccttttttgaatgttccgtaatttcccagaaaaatattctctgccaccgtgataccgggaatcgttcctgcctcctgtacgatcattccaattccatttaaggccgcctctaaggtattggccggcttccaggccgttcctttatagatcatctctccgctggtagccggctgtatccctgcaattatggaagaaactgtggattttccagaaccgttttcaccgatcagtccccggatttccccgcggcggaactggatatttacgtggttcagcgcaaccgtcacaccaaaatttttgcacatgtcctttacttctaccagaacctctcctttttccggcatgacaccccctcctcccttttgtttgttcagcctttgtcccccaatgggatttttattggcatactgctattatagaatcccgccatgaattgcgctgtaaataatgctaccattctccattgtttttccgacttgtttttgtccgttcaaaaaaagcaggctccaaagaacctgctttcctccagggaaacttcagtacagctgggaccaggtcccattattttgattcctcaggaagattccgctcttcctgaggagtaattcccatcacctttttataagcctgggtaaaatggctgaaattgcagtaagccagctttgctgcaataaagctcaccggaagggaggtagttttaagcaggctcttggcttctctcatttttcgctgtataatgtattcctttacagtgactcccatctccttcttaaagattctggtcatataatccggattcagatggacatgctccgccagctcttcccgcttcagctcacagtccaaatgatcattcacgtactggatcagctgaaaaactgcggtcttgctgtccacgttttctgtctccgaaaggtaattaacggccacatggtgtaccagttccttcatctggctcacagatttcattccattctggtaaagactgagctcatcctgggcagagaacagcttatagagcagttcttttgaatcatcaatagcgccgtaaagcatggaaaggaaatcctggtaaaaatggagcagtgtctgtgcatccatggttccatcctcaaccatctggtccagcatgtgaaacgcttcctcttccatgacttggggatacccgtccattaacagctttccccagtatctgatgccggccatgtgatattgcctgttctgggaccggtcctcctgtttttggctggtaaatatcccgcctttcaatatcacattttcctgcttctgcttcaccagaaggggccacaccgacggtatctccttcatgtacaaaggaccttccagataacaggctattccgcattttaaggattgttcacagacgctgctgaaatacagaagctggcacttcagctcttccttcctcacttccatgctttcactgtcctgcaaaaccatggcgaacatattttcttccataaagcagactacgatggggcagctgtttgtaataaaaattccatttaccagcctacttagctcctctgccagggatgggccgttccattttacagagagggaataccaccgcacgatctggatcaataccagatggcagggacgccccttcaccggaaggcagcccagccctgcaagagtctcaaaatagttctggttattgataccaagcagataatccctctggacgttggcagcaatgctgatctcctgctcctgaaatgcctgtcccatatcatataccagccgtttttcatttctcttttccacattctgaaccgcttttctgacagcccggacgatctcttcatagggtgccggctgaagaatataatcaaatgcgcccagatgaagcgctctctgggcatatgcaaattccgcatggctggtcagaaagatacaatacgtgtcatatttttcactgcatacccactgaaacagcaaaagtccgttttcttcaggcatttcaatatcacacagcatgacatccggggcctgctcccggaatacttcttttgccttcatagcattctgggctgtttttacggtttcaaaaccttcctttttccagtcgatcccatttaagagaccatgcaggactcccggctgatcatcaacgatcaacagtctcatacctcttctcctttcacttaagccagataaaacaaaagctcaattgcggccccctccttattccagcagctgaccgcaaaattttctccgtataaaagccggaacctccggattacattgaacagccccacatgtacttcattgaattctccgtccccgttccggttcaattcatccatgatttcaccggcaaagcccgctccattgtcctggatgataatatccaccaaaaaaccattttctatggtcttttttacggcagtgatttttacggacagggcgcggtcctgtacggttccatgctttacacaattttccaccagggtcagcaggctgatgggaggcaccttaaaatccagcagatccgggtcaatatttaataagcactgaggcttttcttcctgcccgacggcctgaagctgaatatagttttcgcacatctgcagctcccggcttaagggcaccagatcactgcttattgtgaacgtataacggagatgactggaaagaagcagaatcatcccctgtatatcctgaaaggaaccggcctgggccattccgtaaatatttttcaggcaattgagataaaagtgaggatgaatctgcatcctcaatgcggccagctccgctttctgggcattcatttctgactgctgtgccaggagcctgtcattttgggctgagattctctgttcatagttttcaatctttaaattggttatggtatctatcatttgattgaacgtttcattcacctgcgcaaattccttgctgctgtatcggcccggacggctttccagatcattggcccggatccgctccatggtttttaccagatcggacagcgggcggaaaaagctgtatttcaaataaatccatgcggccagaagcaccagcgtggacacgccggaaaacagccatggaccaagccgcagccagcctaaggtccccatgttgttccggtagggaactccatataaaacatcaagtcccatcagggtctctttcaccaccatgtactgctgctctttcccggcaaagcggaaatccttcacttcgggaattttgtccacccaggttttcttcagccacatagccggagtcagaggttttcccttctgaacaaacacaaccggcgaagccatggcataattggcctgggaccgtcttgaaatgtcctggatatcgatcaggcacacggccgaggtcgttcccttctgaacgatgcggacaaaaaaccagtcttcccccgcgtgttccataaaccatccgagccgtttttctccctggtcctccagcagccggagcatcagcccttccattgcctttttctcgctgtccgagtactggcttctgcctgcgtatgtttcgcaggccattccaaacgctggtgaatagatggcaaggctggaaatggtctgattgctttccatacggtcttcaaatacggtctccagctccgccagtgccggctccggccgctcagtttcagaagcctggctgatccgggcaaaggcctcgctctcccccatagcaggttcatggtactttccgccagctggatctcgtcggtgatggccgtgcagaagctcagcagagtattccgattcgcttccgccagctgccggtttaagtgggaaaccgcttttgtggtaaatatgctgaacaccagagtgagcggaaccaggatcaatattacggcaagcagaaaccggtatttgattgaaattcgttttttgctcaaaaaaacacccccttgtcccctgtcatagcaaaaaagggcgctgtcgcatactgtcggatcgctccctttttcatcggatatttgtatccgcatggatcttattatgtccattcctatcaccggatgaaatcattcaacggcaatttcttttgttctgatcatagaataacatagccctattatgatttgtacaaatttcacccaaacgtttgagtatgatgttatacttttactctccatctcattatatatcgacaaaaggctataaaaaaagagctatcgtatggttacatacgataactctctttcatcatgccggcgaccggaatcgaaccggtacgggaggtaagtcccgcaggattttaagtcctgtgcgtctgccagttccgccacgccggcattctcatataccgttttacttctttccaacggtacggactgggtggagaaggattcgaaccttcgaagtcgtcgacaacagatttacagtctgccccctttggccgctcgggaacccacccatgcttttattaagcaagcgagtgttattttatcacagggacattaaaaaatcaaggttttttagaaaaaaataaaaattctaatccgggtcagcaaccagcaaaacagagcttattccgggcatggagacaagcacctggccgttctctacctcataggatatcttccccacattgtagccattttcataggtcagcatgtagcgggacatggtttctccgtctttcattcccaactgccaaacagggatcatgacctgccgttcctccggaagattgttgaccgccacggcacaaatgctgtctccgctgaaacggccgtaggagatcagatgctttccggccagaagctgctttaaggatccaaggcgcagcgccggtatgctgtggtgaagtcctgtcatataccggtgaaattcgatcagctctaaatcctctttcccccagggataggtcctccggttatccgggtccgtccagccgcagacccctgcctcgtctccataataaatcgtaggcgcaccgggccaggtcatctggatcataaccgcttctctgaatattccattattgattccctgggaagccgcctccgggcccagagtggatgtccgtcccacccttcggttggttcttgtcataaaacgggaatgatcgtggtttgacagctcattcatagctatctggatggagcctgtcatcatacggctcatatgataattcatggacttaaaaaagctttccccatccccgaacaggctgggattgctttcgtcgctgtgtttttccatccctgtcagaaaccaggtcacaggctccatgaaggcatcataattcatgacagtatcccactggtcgccctggagccagccggatgggtctccgtagtgctccgccagcacaatggcctcaggatttgcttccttcaccgccttccggaaatccctccagaatttatggttgtactcgctgctgtgccctaaatcagcggccacatcaagacgccagccgtccacattataaggcggggacacccatttacgggcgatctgcaggatatactcgtacaaggccagggaatcctcataattcagcttaggaagtgtggaatgcccccaccagccatcgtaagacccgttatagggccaggcttcctgatcgtaaaatttaaaaaacgtccggtatggactgtcctttgacacataggctcccggctcgtaccttcctgacatttcataaatacgttccccatccagccatttattaaaagagccgcaatgattaaatactccgtcaaggatcaccctcatcccccgtttgtgcacctcttccacaaaccgggcaaaaaattcattgctggcttctaaattctctttatctgttgtccggatcatgtattttgtggcatactggttatccttggcatcaggagccaccggctccccccatcttttgcgatcacgccataatggggatcaatgtggtcgtaatcctggcagtcatacttgtgattggagggtgatacaaaaataggattaaagtaaatcacatcaactcccagattctttaagtaatccagcttatcccatactccctggagatcgccgccgtaaaaataccccacatccatctggttaggatattttccccagtcctttacaccggatacgggacggccgatgtacacatattccccgtccaccacgtcattagtcacatctccgttgcagaaccggtctacataaatctggtacatgaccgcacccttggcccagtcaggcgtagaaaagccgggaaccatacgaaagtaaaaaccttccggattatccccggaaggacccagccggttatagtaacagacctctccgccctttataaccttaaagctgtagctgatattctcataaactgccgtcaatctatatttataataatcgaactgcccgtcggactctgccttttccatggctgtctcttcatttaatccatcctggatataacaaacctgatctgcatcgtcctttgccgtccgaaaaaacaggatcacatcatccccaaaccgggttctgccgggaatcggaaactttctgtctcatcagtaaataacgcatctttatttaacgcctcagcctggaagcacatataattttcatttcctttctcgtcgtctatacgttctattttatccgattgaatcaaaatatacaacccgcctttttaagtaagaggcagaaaaaacggtcagcggggcagctgaccgtttttcggagaaggtatttcgtttcttatggggtgtagcaaaaactatataatgtattgggggggtttacgattattactataccacgactaagaaaataagtgtgcacaaacatcatttttttacttgtaattttttatgcatttttcctctgtctccgcattaaacacaaaaaagcacagaatccaggaaaaaacttagatattttcccagattctgcgcttctatctcgtttaagacggcagatgactttagccttctgcaactgcagaaaacagactttcgaattcctgctgtccaattttttccttttccatgagcagcttacagcaggcgtggagcacttcctcatgctttaagatgatctcctttgccttttcatagcactcatctatgatccgttttacttcattgtcaatggtgttggctacctggccgccatagctctttgcatgggccaaatcccggccgataaagacttcatcgccgtcattatcataatttatcatgcccaccttatcggacatcccgtactgggtcaccatggccctggccacagctgtggcctgcttaatatcctgggaagctccggtggtgatatctccgaaaataagctcctctgcgatccttccgcctaaatccaccataatatcctgaagcatcttgcctctggtgttgaacatatggtcggtttccggcaatggcatggtatatccggcggctccgactcccgtaggaatgatggaaatagtatgcaccggcccttcatcaggaagcagatggaacaaaatcgcatggcctgcttcatggtaagccgtgatcctcttttccttttcagtgattaccttgctctttttctcggctccgattcccaccttcacaaaggccttatcaacatcagcctgattaatgaatttcttgctgtgtctggctgcatagatggccgcctcattcataaggttctctaaatctgctccggtgaatccggccgtagtctgggcgatccttcttaaatccacgtcctctcctaggggtttttccttggaatgaaccttcaggatttcttctcttccttttacatcaggccttcccactcctaccttccggtcaaaacggccgggacgcaggatcgccgggtccaggatatccacacggtttgtggccgccataacgatgatcccttcattgatcccgaagccatccatctctacaagaagctggtttagggtctgctctctctcgtcgtgtccgccgcccatgccggtacctctgcggcgggctactgcatcgatctcatcgatgaatatgatacagggggcatgcttttttccttcttcaaataagtctctcacgcgggaagcacccacacctacaaacatttccacaaaatcagaaccggaaatggagaaaaacggcacccctgcctctcctgccactgcctttgcaagaagggtctttcctgttccgggaggccctacaagcaggatgcccttggggatccgtgcacccacactggtatacttctgaggattctttaagaaatcaaccacttcttcaagctcctctttttcctcttcaagccctgcgaccttgccgaagttcaccttatttgcatcctttgcaagatgagcccggctccttccaaaattcatcattttggcatttgcgcttcctgctcctgccctggcgttcattaacatgaacagaaaaactaaaactactgccgtcaggatcaacggaagcgtaatggtcaggaataaattttccttttgtactgcatccaccgtgtaggtgactccattgcggtctaaacgatcctgaatctcaattacattagacacattggcctgctttgatgagccgtcagtcatggccatctcgatccttcccgttgggggcgggtcactctgcctgatagttgccgaagctatggtcccattatcaatcgcctgcataagctcctggttggtaatgatctcactcttttggggcagcctactggcaaatataagcatgatgaccagaaggagcagaaatcccaagcctctgaatggttgctgttgtttcaacatgctgcctccttattgctgttctataactccaatatatggtaaattcctgtatttctgatcgtaatcaaggccatatccaatgataaacagatccggcacagtaaaacaggtatacttcaccttaacctgatccttcacccggcgctccggcttatcaagaagagtacaaagctcaatgctgtttgggtttctctgctttaacacctcaattaaataggccagggtattgccggaatcaatgatatcttccacgatcaatacatccttcccttcaatgggatcatcaaggtctttgatgatcttaacgattccgctggacaccgttccggcgccgtaactggatacggacatgaaatccatagtaaggggcagattgatcctttttgcaagttcacaggtaaagaaaacgcctccctttaaaatgcagatcaaatgaagaggttttccctcataatccctgcttacctcgtctgctatttcttttaccctttttgctacctcttcctctgataacaatatgcgtatcttttcatccattgttctttcctccgtctaactgcatttgtattactgtatgggtatcatctgttatcttataatattcactgatccggtatccgatgacccagaggacatgggaaccttccgccaccaggggaattttttcccgttcctccttgggaatcttctcatcaatcataaatgccttgatggtttttctgccgcctccggccagtgtcatgtaatctccggtttcacgatacctcactgagagtgcacatttgattttatcataatcaaaccatttcgtatacccgtttttgggaatttcctggccttttttgtaaggaaagaccttaaaatccagttcagggagaggaaaatccctttccttatccaccaattcttcccgtttcttcttttttatccacaattctcctgccgtgcgcaccgcaataagcccgcagggcagatccacctgtctgcggtcagaaccaaaaagaagcgctgctgcgctttccacgtgagtcatggtaatatccttcatggattcattgacagaccggatcatcctccggatcacatagttctttataatgtcatcttctgccagaagggcctttgcctccacgccaaggcctctttctgttcctgcctcatccgtttcccatactccccgggcctttagtatctcttcggcctgtttctccagataggcatcggcctgagcggccatttcccctgcatgaaggatgttttctcctgcccgtttattgaccttttccctgatctccggcaggatcctgctccttatgcggtttctcacataatctgtctgggcattggtggagtcctcacaataagatatccttttttcctccagatatgcaagaatttcctctcttccaacacacagcagcggtcggacaatcctgtcccggacgggacgcattcccccaagtccctttagccctgttccccggaacaggttataaagaatagtctccgcctggtcatccttatgatgggccaccgctatttttgttcctgaaaagtccttgcgctctttttcaaaaatctggtaacgcagatgccggccggcctcttccaccgacattccctgttcctgggcataaagggccgcatccacctggacgcaggaaaaagccaccccagcttttttgccagctccccggcgtaatccctgtcccggtccgcctctttccctcttaggccgtgatggacatggactgcctttaattccagtcccagcgcttccttaagctcatttaagactacaagaagacagaccgaatcggcccctccggaaagcgccactatgacgcggtctcccggagcaaacagccggttccgtctgatataatccaatatcgttctgtacattcagtcaccttccttagttgattttctcccctctatattataaatatacccacaaaacatgtctgttgcaattattattttcttttccatattccggcagtcataactgtcatgtcatcggccaccctgtcatgaaaggatcttgcgaacaaaaggatcctgtccgccatatcctggggattctttaccggcattccggcaatgaattcctttaacatcagttccttgtcatccgccggaagggcgtctagcacgccgtcacttaccataatgatcctgttgtcatcccacagctttttagataagagaacaggttccaccgggtttaagattcccatggggacctcaccggcttccaaaagctccactcccttttcactgagaatataggtggccgccgctcccagcttcatggcctctaagatccctgtttttaaatcaatacagcacaaatccagggttgccggatgctgggagatcccggtcaaaagaaggaccgtattgaccatcttaagggccgctctggtggaaaacccggcctccagcagtctttgggtcagttcaatggcctgtctgctctcctcttcggccgccctgccgctgcccataccgtcggacaggctcatgatgacttgtcccggctggacttgtccaaaggtgtaattatctccggacacctcttccccgctttttaccgccttagccacaccgtaaaggacccggtactctcctttttcaacaaaccgtatggtatcggcctgctttgtcactaagttcctgccgtcaggggccactgtccattccccttcctctatggctttttccagaatctctgcggcctcctttactgtcacacaccggccgtttaaggttctcatggtcagaaatgcttccctctgatggttctcgtattctaaaatgagcatcttttcaacaatgatatgattgcggcggaatgcccgctttatttcctcctcccagtccggagtgatgtccacagaatgctccacctgatgagaaaactcctccagaatcacagccagctccttaaactggacaatgaccgcatcccggctttccaaaaaccggtttttccaggccagattcatagtggctcttcccaggccccggtttaaatgagccatgtattcatcctttttcttacaggtctcaagaaaaaaacggggcatgtccccgtagtcaacactccctttttgttcaaatgcacgaaccagatattgcagataatattgattgtcctgttcttttccggaatacacaatgcatttattgcagcctgcgcataccatggccgccgctgtctgaagcgccgcaatgccgtcttcctttgtaagtccctgttctgctgacaagtcatctgtacaagccctggcaagctctcccaaagagttcgccatgtcgtttaatctttttgccgtatatacattcacatcagccatatcgtgatgtgccgccttacgtctgaacacaaaaatccctcctgcctgtatcatgctttaaaccatactatgaaatcaagctttcataatttcttggccggtgcaaaagcagcacccttttatgagaggctggaatgcagcgtctcataaaacacattatatacaggcagaagggaaatatttgtcaaaacggctgactcatgaccaaaaatcgtacgacatgtttctgctttaatgtccacgcatttcggacgcagaggatgctccaaaagtatctcactgtctttgggatggtttcagcaaaatctcatcaggattgaccagccccagtttttgctttgccacctcttctatgtattgcttcgtctggacatacacccggtattcttccagttttttggaccgttcctcttccttgtccacctgggcctgaagattctccagacgaatttcatattctctctgcttttcctttagggtgactcccttaatggttacaatcacggcaaggctgaatacgacaaaggtaatgccgatgatcgtcattcgattgccccacctgtcttttctttttcttcttgattttcccattttgtccatacaatcaccaattacctttaacgccgtttcttttttcggttacagctatctaccttcattttaagatatttccgaaaatgtttcaagagttttagaaaatgtctgcttactattttatcatacaatagcattccaagaaataccccggcaacggcgtaccctcttaaacctccgtcattctgttcatacagcaaagaaaacgtgaccaaggcagcataaacccagtatatcatgtcctctattcctacaaacacataggaatggggaataaaaatacggaagatacgtaacaggtcatatgtgatcataagccctgcgcctgttaaaaagctgtagagcagaagttttacttcgtaaatgatatgaacgctcatatgactccttctggttcttatttaaacagcctggaaagcatggattcccctgacctgcgcagcgcttcattagaggaataggtaaggctctcaatgttgccgtttaaatccacttccccttttcaagggtcaggcggctcacatggagttccttcccttttaaagtcaaaagtcccatgtccgtatcaagtaccacctggttctcatcaaaggacaccacttcccgtattcctgtcatcgtcccggaggcccgattttctattgtcagcctgtgagggcgaatcgtcactttttcttccatacaaaaacctcctaatatacctgtctaaagtatattaggaggtgcgctccaatattactgaaatttatcgtacgtatcgaaactgtgagctagagataacggtaaagctcctttgcttcatcctttttaacggtttccgccacatcaagaacttccacctttaccgagctagtcccaaaatgaatctctattatatcgccttccttaatgtttaaggaagctttcgcaggcttgtcattaacaagtacacggcctgcatcacaggcttcattagctacggtccttctcttgatcagccgggaaaccttaagaaacttatccagcctcatggattaagcgttcaccatatcctttaaagccttaccagccttaaactttggtgttttagaagcagggatgttcataacttctccgctctttggatttcttccctctcttgccgctctttcagatacctcaaatgtaccaaaaccaactaactggatcttctcgccttttaccagttcctcagatattacatctgtcaaagccttaactgccttctctgcatcctttttggacagctctgctttttctgcgactgctgcgattaactctgctttgttcattgatatcttcctcctagaatgtagcaccaggctacgatttttcgcataacacgattactatatcatttatagctgtttctcccgtttttgtcaaggtttttcgcacttttggaaggctttctcctgcttttttattgcatcccagagagcttgtccttcttggtgcaaatctgggtttttcccgccgaaaacgtgagggtgtctgcgtatcattttttcactgattccgttcaccacatcatccatggaaaagtctcctctttcctctgcgatctggctgtaaagcattaccagaaacagcacatctcccagctcttcacaaaggttttccatatccccatgatcaatggcttcaagaacctcaccgctttcctctttcaaacattttttcagactctcgtaagtctgctccctgtcccagggacagccttcatcggaacgcagtttatttgtaatatttactaaatcatcaaaagtatgcatggctcctccttcttttgcgactattatggcttacgtctattatatcatggcatggcagcccatacagaatgctttttttaatttctgaagattttctgacaattgcttgttccccctgttaaaaaagggcttgttcttatataataagagggattatttaatgaaaccggaggtagccatgaaaaattttagcatatggaaaaaaatagcagcttttgtgctgtttttgaacattgtatttaccgcatttaccacagagcttctcacacctgccacttcggccggagacttgacggcacggggcatgagctttggacctgcccttaatatcggaccgggcagcaagatatttaacggcggcagcttatccctgcttgcagactacgacaaccggcagatgctttccatggttttgcaggacaaggacggaacccttgtggtcattgacggcggctgggacattgatgcagcacacttaacggatgtgcttcgttccaagggcggacacgtatccggatggtttatcactcatcctcactcagatcatgtaggtgcccttgtccagatcctgaataacccggacagccagatcaccattgacaatgtgtattattccctggctgatatctcctggtatgaaaaggtggagccttcccggaacgatatggtgtacagcctgatatcagcgcttgccactcttcctgcagaaaaactccataccgtgcaaaaggatcaggagatccagctgggacagataaaggcaaaagttttgaataacccttatcttctggataccacctctgtaaataacagctccgttgcttttaaatttttcttaaataatgtgagcatcctggtgctgggtgatatgggccctgaagccggccagctcttatcccaggaatgcaccccggaagatttaaaaagcgacatcgtccagatgtcccatcacggccagtacggtgtcaacaaggaagtatatgccattatcaagcctcagatcgccctttggccctgtcccctctggctgtggaacaacgacaacggcggcggaatcggaagcggagactggaagaccctggagacacgaaagtggatggaagagctgggagtaaaggtaaattactgcatcaaggacggagaccagatcatttattaataagttcccatgaaaaagaaacggcatctgaacacaaaaccagtgttcctgccgtttctttttttgtgtaaacctggattattagagaagtatctgattagtttcctccaggaccgtcccgcctggggcgctccgattccggcaatggttcaatgtaaaatccatctttgtatggctccgtatcaatttccgggatatcaccatcactgtaatcatcttcctccggtacaaaaaccttcatatttattcacctcctgattcatgtattctgatctgcatttgttagccttccatctgacggcctaaaaatcctgctgccgtcgtagccagctttgtctccatatctccaaaacgtgctctgggctctctgctcaataaggctacagctcctatggcatcaccttcgcaaataatgggagccaccacctgagccgttattccttccagggtttcccctgacagaggaataaagctcttgtcgtcttttccggacaccacgaccgcccgttcattgataaggttctcaagctgcttgctgatggtcttctggagaagctcctttttggaccctccagccactgcaatgatctgatctctgtcgctgatacatacggtaagtccggtagtctgagccatggcttctgcatattgggaagcaaaagcagtaagttctaccatcggagaatatttctttaaaatgatttctccttccctgtctgtaaatatttcaagcggagtcccttctcgtaaccggagcgtccttctgatctcttttggaattactacgcgtcccaggtcatcaattcttcttacaataccagttgctttcataataaaaattcctccatcttgtgcattttaatgtcgctgatattattttgctacgaatgcaacagattatacttaagtctgccatttttcccaaaatttaaaatcagggccgactgttaaaaaaagtcgaaccctgattttttagatcaaactcagtttattgcttgcagaagccggggtttttgaagcccagttaaaagtcaccctgcctcacacggcgcagcacttcctttgaagatgataaatatccttcatgggccgcccttgcggccgcgctatctggaatgggagttacaaaatggttttcaaaagaaccatacttttgaatcgtcaattcatttgatactctttgcagaagatacatacctaaaacgtccatagctaccacctttctccgaaccataaaatttgaagcaaagaaagcatctgggactaaatcccttcttctactattagtatatcacaaaaaagacaaaaatcaaccaaacgaactcattttataaatacaacttttatattttttcattcttttcagacaattcttgcatctgttttaagatcacctctgcctggctgatcatggcatcggtggactggttcttctttctgtcaagatacgaaaaccttggttcttctcccatctggaactttaaatcccccttatactggtcaatcatcccgggaattccttccaccttcagctttgcattcttatacatggtcaggcggatctcctgacggttgatgttcacttcggtcacataggcgctgtgagccagggcttttaagctggctacctttaacagattatcaaccggtcttggaatatcgccgaaacggtccatgagttcatcctgcatatccatatactcttcttcattctcaataccggaaatccgcttgtatatatcaagcttctgatattcgttcttaatataggaagtgggaatgtatgcgtcaatgtcgcagtccactactgtctcatagctttcctcttctttcctctgtcctttaagctctaaaaccgcctgatttaagagcttacagtaaaggtcatatcccactgcttccatgtgtccgtgctgctctgcacccagaacatttcctgctccccggatctctaaatcccgcatggcgatcttgatcccggatcccagttccgtaaattcccggatggcctgaaggcgtttctctgcttcttcctttagcagcttatcccgcttatacataagaaatgcataggcagtccggctggaacgccccacccgtccccgcagctggtacagctgggaaaggcccatgtggtctgcatcctggatgatcatggtgtttgcattgggaatatcaaggcctgtttcaatgatggtggtgcagaccaggacgtcgatttccccgtttacaaagtcaaacatgatccgttccagttcatgctcatgcatctgtccgtgggcaaaggtcaccgctgcttcaggaaccagaccggcgatgtggtttgctacctcatcgatgttgcttacccggttgtatacataatacacctgtcctcctctggaaagttcccggtgaatggcttcccgcaccatttcatcgttgtactccatgacataggtctggatgggcatacggtccacaggaggctcctccagaacgctcatgtccctgatccccaccaggctcatgtgcagggtcctgggaatgggagttgccgtcaaggtcagcacatccacgttttccttcagctgcttgattttttctttatgggccacgccgaaacgctgttcctcatcaatgatgagaagccccagatccttaaactgcacatcctttgacaggacccgatgggttccgattacaatgtccaccatgccccgctttaaatcctccaaagtctttttcatctggcccggagtccggaaacgtgacattaaatcaacccggacgggaaaatccttcatccgctgggcaaaggtgttgtaatgctgctgggcaaggatggtagtaggaaccaggtagaccacctgctttccgtcctgaactgctttgaatgcggcccttaaagcgatttccgtctttccgtatcccacgtccccgcagatcagacggtccatgatcttcctgctctccatatcctccttggtggcctctatggcatcccactgatcctcagtttcctcataaggaaacatctcttcaaattctttctgccagaccgtatccactccgtactggaatccatgggtctgctgcctggccgcatagagctgtaccagctcctttgcaatctctttgaccgcgccctttaccctggtcttagtccggttccactggtcgcctcccagccggttcagctttggctttttcgcctcggcgcctgcatatttctggatgccgtcaagccttgtggcagggagatacagatttccgttatccgcatactctacttttaaataatccttgatgaccccatcctgctcgattttttctattcctctgtagattccaaggccatggtcctcatggaccacgtaatcgccgatggagaggtcggaaaagttctggatcttggtcccttcataggtggtctttttccgtttccgcttctttttttctactccgaacatatcgccttccgtgatgacgataaactttatcatggagtattcaaagccccggtggaggtttccaaaggtgaccaggatttcccccggccttacctcctggctctctcctccctcgtcaggacagtaggcccgtaagtcatattcccttagatcccctgccagacggctggccctggtcctggaggcagataaaaggatcacccggtacccttcttttttccatctggtcagatcttttattaaaagctcaaacccgttttgataagtatttacattctttacctggaagctgtaacggttttttaccgtaaagccggaaagcttctgttccaggccggtgagatacaccgtggttttcgtctggacccttgccagcatttctttggctgagaaaagaagcccggtctgtccggggagaagatagccgttttccaggcggtgtatcatgctttcccggaactccatttccacggtttcccctttttccttaagccgctccggctcatccaggaataatacggtattttccccatgaaaatactccagaaaagacacgctctcctggcagaaataatggatatatccgtccagcccatgctgtctgaaccccactttaagcccctctaaaaattcggagacaatggaacggatcctggcagactcttcgatctttgactgggcccttaaatccttttcgtacttttttgcttccttttcaagtgcttcgatcccttcctggatctgcttccctgtcagggccatttccgtggcaggatagatgcggatgctctccagctgttcaacggacctctggctctcaatatcaaaggtcctgatggagtccacctcatcatcccacagctcaatgcgcaccggcagttcttcggttaagggaacacgtcaatgattccgcccctgatagagaactggcccatgccatccacctggcccatgcgctcataccccagctctgtaagacgttttttccatttttccacgtcaatggtctggccgccctccacggtcagcacctgctcctttaaatactgaagagggagaagatggtccataagcccgtcaaaggtggtaaccacccatccggaggacttttccattaaatggcggaacacggtcatgcgctgcttggtaagcaaattaccgtggatgtccgcgctgaaaaacagaagatccctggccggatacagccacacatcaggatcaaagaaccgcagatcctcatagatttccctggctcttgtatcgtcataggtcaccaccagccttaagccttcctgcttcgccgcttcatacatcaggtggaccttttgggaatccatgcagccgcttgccatgacagggccggccttttttaataaatcgccggaaagatcttcaaaatcctttaactccctcaatggtttttcaaatagatcactcatgaaatctccttatttctttctgttaaaataattcatcgctgcttccgctccgtccgtgaccatcataatagcagcctctgccgcgtccttgtaagcctgggccatgacctcctgctgttctttgggaaaacggccaagaacatagtccgccagatccatttcctttggcttttctcccactcctacacggacccttggaaattcctgggttcccaaatggcttatgatgttttttaacccgttatggcctccggcacttccctttgtacggatcctcagctggccttcccctaagttgatatcatcgcagataatgatgatatggtccggctccaccttgtaaaaatccgccatagcccggatgctctctccgcttaaattcataaaagtctggggctttgacaaaatcaccttttccggcccgatccttccggtcccataatatgccctgtgctttttttccgtcaccctggctcccagtttgtccgccagaacgtccacggtctcaaagcccacattgtgtctggttttttcatattcccttgtggggtttcccaatcctgcgatgatatacatgatgattctccttactattgtctatattaattacggttccgattcatgactttttagatgttccaaacgcccgaaaagcgttagatttcccaataccgggggtctaacgctgcttttttattttaacagttcaatcttaagatgtaaaggcaaacaccgcctttttattttttaaactgttgaaatgcaaaatgcttccagttataataataataatttttattctggaaggaaggatagcatgaaaaattataaaaacccacagtttgtccggctgaaatcattccttatttcgatcttgcttctcttagccatggaagcagtttgtggaaggaatctcttcaggcggcatgaagggctgataatggaaaggagatttttatggaacaatgttcaaacacttaccgcatgatcgttttaagctctctggaaaaggtatttccccaccaggaacctgtattctcacctgaatgctgccgttttaacggcctttacggggaaattctcacctaccaggccgcctgctgtcttaaaggcctgagaaaagaaaaattaaaggtgagagttttctctgccttaaaggacagcatccggatccggcaggtacttcacgtgccctcctcttaccctgcccatgaaaaacgtgacagcaattatttaagccatacccctggtctttacccggaccttctacggaatctggagaacaacagcctggttctggtgccgggccgctggcagagcctgtggatcgatgtcaccataccaggtatcattccgggaggcctctacccggtgaccgtctccctgactgacagccaggacagggaagtggtttctgtgaccgtgggcattgaagtgattccaatcccccttccggcacaggaactctaccatacggaatggtttcatggggattgtctggcggattattacaaggttcccgtgttttccgaggagcattggaatattctgggccgttttatttccctttatggaaaaaggggaatgaacatgattctcactcccatctttacgccgcccctggacactgcagcaggaggagagcgcaccaccatacagctggtctccatccgccaggagaaaaaccgcttcttttttgatttctcccacctggaacgatgggtgaatatatgcaaagatgctgggatcgtctattttgaaatggcccacttattcacccaatggggtgctcaccatgctccaaagatcatggctgaaagagacgggaaggagatccggctctttggctgggataccccttccaccggcgcctataccgttttcttagaccagttccttccggccttaaagaaggaactgaaacggcttgggatctttgaaaacacctttttccatatttccgatgaaccggaaaaggctcatctggaatcctatgcccttgccaaggaatctgtgatgccccatttaaaggactgtaagctcatagatgccctgtccgactattccttttatgagatgggaattgtggagcgtccggtctgttctaccgaccatatagaaccgtttctggatcataaggttccccatttatggagttattactgcacgtcccagtgcgtggatgtttccaaccgttttatggccatgccatcggccagaaaccgggtttacggccttcaggtatataaatatggaatcgagggaatccttcactggggattcaacttttataattcccagcattccctgcgccacataaacccttatgaagtgacggactgtgacgaaagcttcccatccggcgatgccttcctggtctatcccggccctgacggcgctcccgaagaatccatacgccttatggtcctccatgaggcaaaacaggatcacagggcattaaaactcctggaatcctatatcggaaaagaggctgtcattgaacttttggaagaggatttatctgagcccatcaccttttcttcctatccaaaatcaagcgccagcttaataggaattagaaataagatcaaccggatgataaaaacgtacatataaaaaagttcatccgaaccatggatattacttgtcatttccatatccattatgatagaataaagctgttgcgcttatataagttcataatcggttgagcgtttctaccaactaccataatagttgactataagggttagaaggaaaaaggagtgatgttcatgaaggatgtttcaaaaaattacgatgtaatcatcatcggtgcaggcccctccggcattttctgcgcctatgagctgatcgagaaaaagccggaccttaagattcttatgatcgaaaagggccgccggattgaaaaccggacctgtcccaagagaaccacaaaaacatgtgtaggctgcaagccatgctccattaccacaggctttgcaggagccggagcattttccgacggaaaattatccttatctcccgatgttggcggaaaccttcctgaaatacttggatatgatacgaccgtagagctgttgaaggaatcagacaacatttacttgaaattcggtgcagacaccaatgtttacggcattgacaaacaaaaggagatccaggaaatccgccgcaaggccatcggagccaacttaaagctgatcgaatgccctatccgccatttaggaacggaagaaggctataaaatctatacccgccttcaggagcacttattggagcagggagttgaaatggcgttcaacacgatggtaaaggatatcatcatcgaagacaataaagcaataggcgtcattactgacaaggaagaggtctgtcaagcgccggaaatcgtgtctgccatcggccgggaaggctccgactggttcagccacatctgtgaaaaccacggaatcgagacaaaggtgggaactgtggacatcggtgtccgggtagaggtccgggatgaggtcatggaatttttaaataaaaacctctatgaggccaagcttgtttatcataccccgacctttgacgacaaggtccgtaccttctgtaccaatccttccggcgaggtagccacagaatactatgaaaacggtctggcagttgtcaacggccatgcctataaatcccaggaatacaagacaaacaacaccaactttgccatcctggtatccaaaaactttacaaaaccctttaagacccctattgaatacggcaaacagatcgcccagctgagcaacatgctctgtgacggcaagatcctggtgcagaccttcggcgatttccagagaggccggcgcaccacggaagagcgcttatgccgcaacaacttaatcccaaccttaaaggatgcggtcccaggcgatttatcccttgtattccctcaccgcattatggttgacataaaagaaatgcttcttgccctggataaggtgactcccggcattgccagcgatgaaactctgttatacggcgtagaggtaaaattctactccaacaaggtagtggtcaatgctgactttgaaaccagcgtggaaggcttacgcgccataggcgacggcgcctccgtaacaagagggcttcagcaggcatctgccaacggcttaagtgttgccaggagcattctggctgccatgagctaaacggaaggaaataatattcacacatatgtgttaagacagacagggagcacccatgggtgttccctgtctgttttctttttctgaattatgaaaggagcttgtaaagtccgggaattataccagcctcagcttctccatggcataagccacccgtcatcttccacgttttttgtataaaaggttgcataaggctccagctccacgctgtgatgccccataaggatacagttcttggcgtattcaaacatagataagtcattggtgctgtcaccgaatacgtaagtatcttccagggcgatcccatagtgctttaataccagttcaatggccgttgccttggaatatcccgaaggaacgcactcataaaacccgtcaccccggtcaatgatctcaaagtccagccccaaagcccgggaaaagccttttaaatcacttttttcatctgcaaagacacagaatttatcaaagttatagcagtcctcgtcccagccataagaagataaattcccttcctgttccacgatttcctttaatctctccacctggggaaatcgggaggtttcctttctgaaataacagctttccgttccctctaacactccgtccagatcatggtcccgtatgatgcgtttgatctccagcccttgctcgtgggggattgcagaggagaaaaggacctggtctcccacaacgatacgggtgccgcacccgcagcagtagccgtccactttaacgagctgctcaattggtccgatgaggcagtgggtccgcccggagtttatgaataccagatggccctttttccgcgcctgctcaaccgcctgcttcgcactctccggcacgttccggtttacctcagaaaaaagcgtgccgtcaatatcgaaaaacagagcctttcttccctcactcatcggtcaccccgaaagcatatggttcccgtggtttcatccatgctttccacgatcgccagggattccaccaggattccttccgcccttaaacggtcccctccgggctggaagcccttttcgaccacaattcccgcgccaaccagctttgcgccggaagcctttacaatggcagccagaccttccagggcttttccgttagccagaaaatcatcgatcagcaataccttgtcccctgctcccagaaattccttggacaccatgatgtcataggtccttccgtgagtaaaggattccacaggggtggtatatacatcccctgctatgttctttgtcttggatttctttgcaaatactaccggtacatcaaaatactgggccacgatacaggcaatgccgatgccggaagcctcaattgtcagaatcttattgacttcataatcggaaaagcgtctcttaaactctttcccaatctccacgaacagcttgatatccatctggtgatttaaaaaactgtccactttcagcacatcaccggatttaatctttccatctttccgtattctgtcctttaaaagctgcataaaggttcctcctctttatagaatccgcagtgcagccgttgaagctgtacggcttcaacggctcacgggcattcgccctatgaaacaaagcatgaaaaaattttcttatgtgcgggcacaacgaaaattttctcctgctttgtttcgcactgctcgttgctttcgtgaattttatttaataactgcattttctgtaaggaaatccattaccttgttattcataatataatcatctacgtcaaactggcctgctgtctcgatcatcgcttcaacgctttcatagcccatctgatctgcaacttccttgcggtcttcatcggtgatcacgatcccctctttttccgcaatggcggttactaccagtctctgttctacggtggcctctgcctgggtcataatgatgttcttaaagtcctcttctcccattccggaaaatgctcccacaaaggtcttaaagtccatgccgtaagcagctgcctggtttgtatatctggcaatcatgttgttgaaattggcatcaatggcttcctgctttggctctaccttggaagcatttaagatggcagtataaatgtcacttttcaccttctgctctgcctggtcgttcttatcttttaaaagagtctgcatcttgtcatccttatattcatctaccgtcttaaaggacgtattttcctgaacaaaggcatcgtttaattccggaacctgcttctccttaacggaattgacagtcacatcaaatactacggcctttcctgccaagtccgcattctggtaagcttcagggaaggtaaggtttaaggacaccttgtcccctttttcgcacctacaagaccttcctcaaagccttcaataaactggccggaaccaatgtttaaatcatagccctgagcagtgccgccgtcaaatgcaacaccatccttggtacctacatagtcaatattgaccacgtcaccattctgaatggcccggtccacctctgcatcctttgcctgggcggataaatcgctctgaaccgcctggtccacctcgtcatcagtcacttcaaccggatccttggtcacttcaatccccttgtattctcccagggtaacagtaccgttatccattcccgtcagatcttcaacagccagggtttcctgtgccgctgattccgttgcttccgtctctgtttctgccggctttgccgcaggctttttcccgcatccggaaataagggcggcggcaaccagaccgcacatacaaactttaaaaatcttcttcataatacaatcctttttctttctatttttaatagttaataaaaaaaccgcttccagtcagttataccatatcagacaaggtaaaaaaagctttttcccgaaattaacaaaaatttcaaaattccgttattatttataaaatgcccggaaagccttgtatgtattgtatacatcaagcttggcagaaagctcgaagggagaatgcatggaaagaatgggaactcctaaatccaccacatccacattcatatgtgcaacatatttggcaatggtgccgccgccgccctgatccacagcccccagctctccgatctgccagtaaacgccttcctgctccatcattgcgatgatctttgccatcagctcggcgctggcatcgttggagccggcttttccacggacgccggtgtacttggtcagaacgcagcccttgtttaagaaacaggaattgcgctcctcgtatacctgggcaaaggtgggatcataggccgcattgacatctgaggacaaacagatggaatttctaagcacctttctcacatcaacatgggccatggcagccagatcttcaatatagtgaagcacaaagtcggaatttaagccggtatttccgtcggaaccgatctcctctttatctgcaagaacggtgagagtcgtaaattcaggcatgttggcatcgatctccgccatcagggccgtataggcacataccctgtcatcctgtccgtaagcgccgatcatactgcggtccagccctacgtcactggccttctgggcaggcaccatttcgatttccgcccgcaaaaagtccgcttccgtgatcccgtagcggtcattgaggagctttaaggccagaagcttcacagggtccttaagctctgcttcgtcaataaatggaatggaaccaatgagtacattcagctcctctccttttaacccatcccttaattttctttcactctgttctcctgacaaatggggaagtaaatccgtcacacagaacacgggatcgccttccttttccccgatgtttacttccacgatctcaccgtttttctttaccacaactccgtgcattgccagaggaacggttccccactggtatttccggatgccgccgtaataatgggtcttaaaataggccaggtcattcttttcataaacagggttgggctttaagtcaagccttggagaatcgatgtgagcaccgttgatgcgaagcccctgctccattcccgctttgccgaaggtggttgcgatgatggacttgccccggttcacaaagtaaaccttatctcctgccttatatgtctttcctccgtcaaagggacggtatccctgcatctcaagcattgccacagcctctctgacacattcccgttcggtttttccgttatccaggaaacgcttataaccctcgcagaacatctccgcttcctcacgctggcttggcacttcctttgcaatatggggaaatttaaatgtcagctcctcctgtaattgttgtccttttgtcttttccattgttatgattcctccatcgtttttttatgataattgattaacagatttcttcgctgtcaagaacaagcgtaaacggtccgtcatttaatagctctaccttcatatctgctccaaagcttccatgctccacccggtttccctgggaatttaaccgatccaccacgtattcataaaggctgtttgcaagctggggacttcccgccttcgcaaagcttgggcggttgcctttcttacagtccgcgtaaagggtgaactggctgaccaccagaatctcccctcccacatcctttagggaaaggttggtctttccattttcatcgggaaagatcctcagcttgcatactttatcaaccattttttcggcaatggcttccgtatctgtatcagacactcccaaaaggagcagaaaaccgttttttatggcgccgatctgcttcccatccactgtgacctttgcatgtgcaacacgctgtaaaacaatcttcatatccattctcctgtctattttaataccagtcttaagtattccaaaaggctttcggtagccgcctgccggtatacgatctctctggcgagcaccgggtaatccgttatgatattatccaccccaagcattttcatccgttccatctcgcttttgctgttcacagtccatgcatgaaccgcttttcccctttcatgggcagcttctaccagtctttcgcttacaaagctggaacggaggctgatgaagtcgatcatatcgctggaataataatccccgtatgcggctgaaataatatatccggtgcggatctcagggtccagctccttgatcctggataaataggaaaaccggacagaggtcaccacgcactgttccctcatctggtgtttttgaatcaattccactaccttatccggcagcatgctgccgattcccaagtccttgatttcaatatttatgctgacccgccctttgcagtattccatgacctcctctaaagacgggatcttctctccctcgtaatcaggggaaaaccactttcccacatccagctgctgcaattcttcaaaggtgtaaaagcttatggggcggtttatccctgataccctttttaaactggcatcatgccccaggaccaccacgccatcctttgtctcctggacatcgatctccacaaaatcagccagatcgtcaacagcttttgtcatggctgccatggtgttttcaggggcctccctggagctgccccggtgggcggtgatctgaatcatgctgagcatgtcggccgtgatcgcggaaccgttgcgcaccactccgaaaagagaagacaggctgaataccgcagctgctcctatgaacagggccgccagcctcctgtctccatacttactcccatgataatccatgattctgcgtttttttacaagtctgctggtgaagctgaaatactggacgcttaaagccccgtagtttcccatggtcagcaacatgctggtcaaaaaaatcaacaccagctcgatccggtcacatgccgccggaaggattgcaagggccaggctgttgtcggtaaacagggtcactcccacggcagcgatcagcacacagaatgcatagaccagccaaagtcccgccactgctgccgcataatagaaggccagaagaactgctacctttaaaaaccggcgccttaaaagccacaggcttttaaaatacccatcccggaaatttttctgttccaccatgcaggcgtggaaggtatagactcccggaatgaccactgcaagaagaaacagcagaaggagcaccaaagatacccttcccacaggctttttcaagatctctgatatgacaaaattaagcggttttacatgggtcagcatctggtatatgagatataagttcacaagcccgtaatcagccagaaccagaagccccagccgccagttctttctgcggatctcaagggccagcttaaaaaagccccccgtcagaatttgccacggcttcagctttctggagtagaatgccccttcaaataaggtcagaaggcagccggtctccagcgtaaggatcaggatccccacagccgccatcactacgatcaaaagaatcgtccagggctttaccaggaaataaccgatgttggcggcagttaaatagctgtatccggccattctcaacgtaaataaaaggcctttgtttaagagcagtaagtacagggtcgtggtgaccagacgaaacagcagctcaaaaacaaacgcattcttttgattgaactttatgatcttccaagtgtcttttgttaatgtgctcatacgataaccttctttttacaacgagaacgaaggaaggcagcctcagcgagcggaatcgtcgaggctgccttcttttaagtctaatcttcctcatccatcctgtcctctcctgctgtctccctctgctgcgcctcactcagttccagaattgcctggtttaaggaaaacatccttccatccagcatattcaccacatctgcacaggccttcagttcctgctgtaaatatgccggggcattgccttcaaacttataatatatcttatgctccaggcttgcccagaaatccattgcaatcgtcctgatctgaatttctactttcgtgtccaccggcccatccgtcagataaatgggaatggtcactaccatatgatagcttttatagccatttggctttggatacttaatataatcctttacataaagaaccgtaacatcgctttgctttgttatcatctccgcaatctggtagatatccgatgtaaaagaacagataatccgtatccctgcaatatcatttaacttttccaccatattgtcgatcgtcacgtcatagccgtaccgcttcagcttttttacgatgctgtccggggtcttaagccttgacttgatatgttcaatggggttgtaattgtagatatgcacaaactcattattaagtatctcaattttcgtactgatttcctttaatgccgagtcatacaaaaacatcacagatttccattgatcgacctggttaaatgatttgggaatattcattccacattccccctctctcgcatccgtactcctgactaagaaaaacacgctttgagggcttttcttagctgccgcggcatttttccaatgaatatgcaagcatatttgttcggcttataacccgcgcaagtcagtgagacaggggcagccccatcgcccggcagcccctgctcctccagaatagtatatcatgaaagcaataaaccaagtgccgcttcaccggcatttggcgactgccacaagataatgaatgcttgcattcattataccatagaaacatgatattttatatcccttttcccgactttctaaaatttcagtccctttaagagggctgacagccctgtaaatgcggaaccttcctccttgtaatcaaagacctcctggctggcttcttcctcctcctgaacagccttcatgcttaagcttatcttattatcagcaatggacaggatcttgaccttaaccgtctgtccctcctttaacacgacacctggatgcttgatcctctggctgctgatctgtgaaatatgaagaagtccggtaagaccgttttccaagttaataaatgcaccgtagtcctttaagctgtccaccgttccttccatgatagacccaacctggcattttgcgatctttctgccggtttcttccttctgcttcataagggcaggctctttgcctgaaagcaccagcttcttattttcctcatcagcggtgatgaccgtgacatcaattgtttttccattatattcctctaagtcctccacatattcccctgcaagcttggaagccgggataaatccccgtatcccttccagataggcgaccgctccgccctttacgatctcggcgattttcaccttgacaatggtgcggtcatttaacatggaaccaagcttttcccatgccagctggtcattggctaactttttggaaagaacaatattcccttccccgtcatctgcgcttacgaccatagccgtgatctcatcaccggggtggatctcccttaataagtcgaattccggatcattgcttaaattttccttatctatgatcccttccgcataatattttaagtccagggtaaccatgtcctcatttacactgataacggtcccggtaagaacatctccctctcttacttttttaaaggacgcttccagctctgcggcgtaagtctccatggtttccactacttcttcttttccgtccgctgccttcatctcttcgctcattgaaatttcctccgttcataaaatactcagttctgcataaaatctaactatatatttatcacatcctgcccgatatttctatagttttctcagtaaaaatatgttatatttatgatataatgaaatattttccactgaaggagctttcctccaggtgctgatacagaaaggacaagaattatgaacgacattatggacctgcatacccacaccgtagccagcggacatgcatacaacactttatatgaaatggccaaatctgcctctgaaaagggcctcgccctcatgggctctacggatcatgcaccaaagatgccagggacatgccacgagttttattttataaatttcaaagtgattccacgtaatatctgcggggtgaacatcctcatgggtgttgagcttaatattttagattacacaggccgggtggatttaagaaaaggccttctggaaaaaatggactactccatcgcaagcctccatgagccatgctataaaagcgggacttccgctgagaatacaagagcttacatcggggccattgaaaatcccctgatccacatcatcggtcaccctgatgacagccgttttcccgtggattatgatacccttgtttctgccgccgcagaaaaccatacccttttggagcttaattccagctcccttcacccattaagcgcaagaatcaatgctgcagaaaattaccggatcatgctggaattgtgcaaacgctaccatgcttccgtcatcattgacagcgatgcccacatagaagctgatgtgggaaaccacacaagagcctgggagcttatcaatgaaatgaatttcccggaagagcttatcgtaaacagctcctttgaaaagctccttccctatattccaaagctggaggcttatttatgatcaacttcctgaacctggaatattttctggcggttgcggaggaacttaatatcacccgcgctgccaaacggctgtacatctcccagcagtccttaagcagtcacatttccaatctggaaaaggagtttgatgtccagctttttaaccgcaccatgccccttaccctgacctatgcagggcgggctttaaaggtccgggccaagcagatgctggacttaaaggatgagacctaccgggagctggccgatatcaaggactttaccaccggacagctttccatcggcatttcccacacaaggggacgttttcttctccctgccattctacctgcttacaaggaaaagtttccaaacatagagatccatctggtagaggggaattcttccgagttaagcactgccctgatccacgggaacatcgatttaatgatcgacctccttccttttaaagcggaacatgtggaaaccgtccccatttgtgaggaagagatccttctcgtggttcctgatcagatcctggaccggtatttcccgggaaaacaggaagagatgatcaaggtgctggaggaaaatgcggacgtgcagcttttaaaggactgtccctaccttctcatcaataaaggcaacagggtgcggaccattgccgatgaaatttttgaggaagcacagctcaccccttctatcctcctggagacagagaatattgaaacggtcctcgcccttgcagccaaaggtatggggatcaccttttatcccaaaatgttcatgtccggaagcggaaacaccggcaatgacattatgaaaaaggccggtcttcattacttctccttaaattacaggcgcagccacggcgttctggcattcggcagccacaagggcagatatctatcccgggctacggaagaattcatacggatcgcacgggagaacatataggtaaatattaactatggattgacaaaagggctgaaatcctatattattaaatagtaacaattactaatataattattatttatagaaaaggagcggccatgaaaacattaaagtatagccgtcaacgggaatccattaaggcctgtctaatgacaaggcacgaccatcccaccgccgatgccctatacacattgatccgtgaagaatatcccaacatcagccttggaactgtctaccgcaacttaaaccttttggttgagctgggtgagatcaaaaagctgacatgcggagatggtgcagatcgttttgatgcggacacctcaccccactatcattttgtatgtaaaaagtgcgggaaggtctatgatctgcccatggagcatttgggagacatcaaccagatggctcaggagcatgtggacggcacagtagacagtcacacgatttatttctacggcacctgcaaggactgttctgaaaataattatcgataaggcttgacatcaggataaagatgtgctaaattaatatcagtaatcattactgttattgattgccataaacatactaaaaaatcattaaaaataaaaaggagacatgagatcatgaagaaatgggtttgtactgtatgcggttacgttcacgaaggggagacagctccggagttctgtccagtctgtaaggctggttccgaaaagttcaagttacaggatgaaagcatgtcctgggcttgcgagcatgaaatcggcgttgcacagggttctccggaagacattatgatggatttaagggcgaacttcgaaggcgaatgcaccgaagtaggcatgtatcttgcaatgtcaagagctgctcacagagaaggctatcctgaaatcggcttatattatgaaaaggctgctttcgaggaggctgaacacgcttctaaatttgcagagttattaggcgaatgcgtaacctccagcacaaagaagaacctggaattaagggttgctgctgagaacggcgcaactgccggtaaattcgaccttgcaaaacgtgcaaaagcattgaatttagatgcaattcatgataccgtacacgagatggcaaaggatgaagcccgtcacggcaaggcatttaagggcttattagaaagatactttggttaatatcctttcttaaaggatttggcacctttcgggagcggcagaacgggtctccgctcccctgtttgcaaagtaaaatcattcacaattcaaatcaggagggtttatacgatgtccaaatatgcgggaacaaaaacagaacagaacttaaaagacgcttttgcaggcgagtccatggcaagaaacaaatatacatattatgcctcagccgcaaaaaaagccggctacgagcaaatggcttccctatacttagaaactgccgaccaggaaaaagagcatgctaagatgtggtttaaggaattacatggaattggttccatggaagaaaacttagcggatgccgctgccggtgaaaattacgagtggaccgatatgtataagagaatggctgaagacgccagagcagaaggctttcaggaactggctcttaaatttgaattcgttggaaaagtagaagctgctcatgaaaaacgttacttaaagctccttgacagcttaaagaacgataagacctttaagggcgatgcccctcttggctggaagtgccgtaactgcggttatatccacgaaggaccggaggctccggaagtctgtccgacctgcgctcatccaaaggcttattttgaaagaaaagtagaaaattattaatacagattttttagtctgttgggaaaatcaggacaaaaccttatggttttgccctgattttcatttattagactgatcattttaaaaataagataatatgagctcaaaggcgatcttatggccctcctttaagctggctgtctcaatccattcctgcctggtatgggccagtactcccctcacggctccaaagcaaatgcttgggatgcccatggataacggtatgttgttgtctgtggaaccggggccttctttgggcttcctgccggtgtgcttataaatgacttcagacacatgttcagccagttcctgtaaaataccttggtttttttcggggctcatgctatacttttaaggtagaaaatgaacgaccggttagaggaaaaagatatgattaaaatcgctattgtggaagatgagacggaatatgtggaaacgctgaaaagctaccttacccggtttgaagcagactattccgtcagctttcagattcaggcttttaccgatggccttgatattgtatcggattataccgccagctacgatatcatactattggacattcagatgaaatatttagacggcatgaaaacggcgcaaaagatcagggagctggatgaggatgtgatcttcatctttatcacctcctccgcccagttcgctgtagagggatacacggtagatgcccttggctatatattaaagccggtcccttatctttccttttcccagatattaaacaaagccgtccgcaggatactgaaaagacaggcaatacattatataaatatcgacacggatggaggcattatgcgtctcggcattgactccgtttattacattgaaagccagcttcaccatgtcctcatccacacggataaagggaactttgtggcttccgggcctatgaaacggatggaagaggctttaaagacctttggctttgccaagtgccacaatgcttatctggtcaatttaaaacatgtgaccggctgcctgccgggtgatgtactgctcctctccggtgagcagattcctataagcaggggccggaaaaagtcatttatggaatgcctggctgattatatgggaggataaatccatggactttggcgaactgatgaatacaccccgtccttttaccgcactggccgaatggtgcgcctgcatcatctacatccttatgcttcgcagaaggcttaaaggaccggggcttgccgtttcttttgcggccatgctgggcctgtttttccttctccatttgattgcaggcacattgccgctgtatttgtggtttccagggatgatcactgccatcctgctgatgtatttctctatttatgcctcctgccggatctctccctatgatgcgggattcctctgtgtccgcgcctttgttttggcggagtttacggcctcctttcagtggcagctgtatgtatggtgggctctcagctccggaagggtaagccagacactttctgttctgatcatggcggtttcctatggatgcatttataccggatattattttctggaaaaagatcacatttcaaaggatgaaggcatggaggtagaaaggaaggagtttctcagtgctgtttccattgctatgggggcttttctgatcagcaatatcagctttgttatgccaaatacaccgttttccagtgccaccagctctcttctctatgtaaggaccctggtggatttcggaggacttttgatgctctttgcccagcagaacaggagaaaggaactgcgggtccgcagcgaaaaccatgcaatgaacgtggttttgcagagacaatacgaccagtaccgtatggctattgacaatatggagctgttaaggcgggaattccatgacttaaagcactatatgatcgccatacgggcggaaaaggatcctgaaaaaagggaacaatacttatcggaaatggaaaaggccattctcacccaggaatccctggctaacacaggaaaccaggtattagatgtggtgctgaccaccaaaagcacctactgtgcccagaatcatattacctttacctttatggccgatggaaaactgatctcttttctccatgtaaaagacatctgctccatcttcggaaatgccctggataatgccattgaatgcgtttctcagtttgaagatcctgaaaaaaggctgatcaccctttccatatacaaacgaaaccgtttcttaatgatccagtgtgaaaattattcggaaaaccggcttgccatgactcccaacagccttccgcctaccacaaagggaaataagctgtatcatggatacggtttaaagagcattcaggccgcagctcagaaatacggcggttccatgaccatttcttctaaggataactggttctgccttcagatccttattccaatccaggaagaggggacggcgggccattaaaaggtgtaagcccataacaggaataaaggagcagaaggggagaatcacggactctcccttctgctcctttattcctgtttttatccaccatttcctgcattttcatacagaactcatccagatccatttctccggcaatgtatttttgaaataaagcccccagatctgccacatattcgatggaatttttcggcatgaatctggcctgcattctggtcgtctttaaataatcccgcatttccttatagcctgcaatatcaaagttctcctcccagatcacatcctcccttgcaggcatccggttcatctttttggcatagctgatgctgccttcccggctggccgcataggccaggaatttccgggccgcctccttatggagggaggccttattaagaacatactgccaggtcgcaatgtaggtggttctgcctcccaaatcaggcaaaggggtcaaatggatcttatcctttccgtggaccccggaatccacaaaggtattcatggtgccgctgtacaaaaagaccatcccgtattttccgtctataaacttctgctccagctgttcatactggtccagcagctgatcgatgggggagtaccccttttccacacagccttttaaaaattccattgccgcccttgtctttggatcattccaattataataatcaccgccgaacaaattgatgaattcccctatttcattatatacataagtcttttcccaggccccgccgtaggcataacagccttccccgtaatccatggataaaaacttatttaagcgctccggagtggtgacatccgtaagccccgccttttttaaataagcatcattgacccacagcatcaggatgtccatcatatagggcacagaataaatctgatccccatccattgccatttcctttaaatactcttgaggaaaatgtgaaaccacctgattattcatcacatcatcctgaaggggctccagataaccggcatgcttgaattcactgatcatttcgtcgtttacgctaatcacatcgacggaggtatctcccgctgacagcagggaagagatcctggcatgcctggaatctgcgttgatggggctttccaccgcatgaatccgcatattaagggctttttccgcctcatcaagaaaggcttcaaactccttctttcctgcatcaatatgcatgatggtgatctcatcctcataagtctccctatctggcccatgggaagctgccagtgtttcttcctggttttgttctggacccgtcctcccgcatcccgcacagaaacaggctgccagaaaggcagccataataaagacggcacagcggtgctgcgagtacgttttcttttgattcagagttttcataggctctctccgtttttatttctgcacacagcaggtttccgatgtttctccttacctgggccaccgttcttcctttttcataagctgcggaaatggctgatgaggcagggtctggtaccagtaggcaacactggcaacgtcatcctgacgctcaaaattccccttatggcaggttccgatctgctgaatggtcacccggagatcctcctcaaagaggatgggatccatgatgtgccaccggtaaaatcccctttggggcatggtatcatcgttatggtaaaaattgtgcacaccctcatcatgactggaatagtaaggatatcccataaacggggtacaatacgtggtttctatggttttcccgttctcctgggccccatagctccatgccccaccgaaataatcctcagtcccggtgccgcagatggtgggatattcctcatctccatccagatagaatttcacttctccctctccccaccagtaacgttccagagttgtcaatgccatatatgtacctacataatgcccttttccttttacgttgtcaagaacggtataatccttctgtttctcggtcaggcgctcccttctccactgggcgtggaaatacagggcatcctcaggcagctcatccaccagacagtaatccacctgatagaaaaaggcaggtacctgggctccatgctggttttctatggtgatctttgcttttttacggaaaggcatggggaaatagcagttcatgcctctggtaggattgaccgccaccggcagggaattgaccagacatcctctggcaaacccgcagcaaaagaaatctcccaaaggggtttccaccgaaggattctcctctccctcccagtacatgcgcagcaccagatccctcagaacatggtaatctaagtccgtccggtccgttacagtgatccagatatgctggatcacacccggtccttccatctccgccagggtcgtcacactgcccggctcaagccctctgatacagggcgagcctttcctggaaggccctaaagaactggcagccatgccgcctttgcccttttctccatggggattttccccattaatggcacagctccttccatgctttgcctgggaaagcataccaagccccccgaaaattgattccatcattatattctcctttcagctttctggctcacgccttcactcctcctgccataataccgtccataatctgtttttcaaatattgcaacgaataaaatgattggaagcaggatgatccagcccatggcgctgaccagatcccatggcaccccatacatattatcccgcagaggaagctgcacgatggcaacgctgagcacctgaatgccgttggaataatacaggggagtgaagaaattgtttaagcaggtaataaaattgatgatgcataccgtggcaatggcaggcttcatcaaaggcaggaccacataaaacagcctctgccggaagctggccccgtcaatggcggccgcctcctccaaagattccgggatctcccccacaaaattccgcaggatcagcactgtaaacgggatgatggcacttacatacaaaaggatcaggccctgatacgtatcaaataagcgtactttctgcatgaattcatacaggggtctggccgtgaccacctccggaatcagcatggtggcaacaatgaacccaaaggccaggctgattcccctggaacggaacctggcaaaggcataagcgcccatggcacaaaacagagtccccaccaccagagtcactccgataatcacaaccgtgttgccgattttagacagcagccctacattccggatcagaaactggtaactgttcagggtcgggtgatccggcaggtaatcaatgggcattttaaaaagctctcccggcggagttatggaggaaatgaatatccagtataccgggaacaggatcagaaacgccacggccccaaacaagcaccatcttcctgctgccactccccatctgtatactttataccttctatcagtatccattttcatatcccttccctcctagtcctcatatcggttcataaactttaagttcagaaagctgaatacagccatgaccagaaacagcaggactgccagggccgaagcgtatccaacgtttaagtttgtaaaggcctccatggtgatccggtatgcgatcagggacgtatcctctcccggccctccggaggtcatggaatacaccaggtcaaaggcagtcagtctccacaaagtgaagggaatgcatagggtcagcacgtttttcatgatcatggggagggtgatgtacaaaaaggagtgaaccccgtttgcgccatccaccctggccgcttcataaatgtccccggaaatgaactgcagccctgacaagactaaaatcccgaaaaagggcaggtccttccacaaatccatggcaatgaccgcggccctggccgtccccgtgttaatgagccagttcatctggaacccgggcacaaaccaccggataaaatcgttgaccaggccgtaatcattgttaaaagcccatttggcagccataccgatcacaacagcgggcattgcccacggaatcagcacaatggtccgtaaaaaccggcggcccttaaaattcatgttcaggatcattgccagagccacccccaggatcacgtggagagccatggaaatgaggacaaacatcaccgtaaatttcagggtagtgatgaccttctcatccttaaatatgttcagataattgtttaaccctgcaaattcatcgactccgctcagcacccggatatcaaaaaagctgttgataaaggttcttacaatgggataaatcgtggtgaatccgcggatgatgatcaccggtaaaatcagcacccaggcgatccattgctgtgatttcctggaaatcatacaggctgcctcctttcactgcctttctattcgccggacaaagtttcctctgccctacttattgtacgtctccacatattcctgggcctttttgcagaattcatctaccgtgatctcatccttcatgcaggactggtaaatggttcccatggctgaaatgaattccattgtctggggaagcattgggcgccccttgaccacacattcgcttgcatatctggaatacattacttttgcaggatccgtatccggcaccaccttttccgctacatcctttcttgcaggataacggtcaaaggctttataagaggcctccatgccttcttcgcttgccatgtattgaaggaatttcaccgcagcctccttatttttagaagccttattcagcacatagctccaggaatccgtaaaaatatatctcttgtccgtgaacttcggcaccattgccatatggatcttgtcttcttccagcatgccggccttattatagtcagccccaagaccccacatgaacaggcagccatattttccgtcattgaatttgggattcatctgctcatatttatctgcgatctggtcaatcggcgtatagccttcttttaccatatcctttaaaaactcaatggcttccttgttggcaggattggtccagtccagataatctccgccaaacatgttgacaaactgggcgatttcattgaaaacgtaggtcttttcccaggaaccgccgtagccgtacctgccgtttcctgacgcagccttcatgtaagccataaaatcctctttcgtatccagggaagtgattccggcttcatcaaggatcttctgattcacccaaaaggccagataaccggaatatcccggcactccaatgatctgtccgtccttgccggtgatcatgtccttcacatatccttccggaaactgtccgcggatatctcctgtcataactgtatcgtttaatccttccagccagccggaattcttaaaggatgcgctcatctcgtcattgatttccaggatatccacgctggcatcaccggtagaaaggatggtggtgatcttctgctgccttgtgtccgaatccgtgggcgcggcgatgacgttgatcttcagccccgtggccccttccacgtttgccagccattccgggaaatccgaatcagtggtgttgatggtatacagggtcagatcgtattccccggcctttttctcccctgttccgctgccggttccttctgtttttcctcctgtgctgcagccggataaaagtccgcagaccatggctgatgccaaagccaggctgattaactgcttctttctcataatgaatcctccttctctttactgagttctcttttttgagatactttcctcatcggtagattcaggataacagaaaccgtttttcatcaaaatacaatttgttttgattcgtttatattattttttggtgctattgaattgttcttttgccttctctataatgaagatcagccgggactcccggaatatgatatgagactggaaatgaggattggtatttatgagaaaagttatgaaacggctgttgatcgcattttcccattttcaggccaagcttctcctggcctttctgctgtgtaccttcatccctttaagtgttatcggctgtatttcctatgccgtctcctactccattgccagggataagatcctggattccgctatcctggctgccgaccagctccatgtccagctaaacagccggatccggcaggccgaaaatgtggcggataccattcaatataatatgtacaccctgggaaaatcctccgggcaggagctttctgcccagcttgaggcgcttacttccgtgcgcaataacatctctctttacaagtccacctttaacttttaccatatctgcatctttttaaaggatgaccagcttggaagcggggaaggactgtttttttatcccatcagcgccatttccggctacggcctgtccttaaaggaattaaatcatttaggttcttcctccctttggctctaccagcctcaggtaaagcttcccgttgtattaaaccatgacaagcctcctgccgatacagtgatctgctgcagggcaatggtgaatcaaggctccaaggagctggaatatgcttatttcatcatgatgagtacacaggaattttccgatatgctcaccgcctccttttcaaatacgaaaatcagctgctttttactgactcctgacgggaccttggctgccggatctgaaaaggagaggaaagaacagcccttaagcttcatcagtgagctgatctcttcccctgacaccggttcttattatgaaaaaaacggggactgttactatgtcctgcccttagaaaatggctggcatcaggtgactgtgatcccccagtcctatatcacagagggaactgcagtccttttgcgcaccattctggtggccttattgctgtccctgcctcttaccgcccttatcatactgctgatctccaggaacttgtcaaaacgggtcaagctgctgtcaaaggccatggaagacttccgcctcagtgcggacatgaaggcggaaaaacattttccccgtccaaaggatcaaagcctttatgacgagatcgaccacctgggcctggcgtttgagcagatgcaggccaccatccgccagaacgtccgctccatcctggagctttccctaaaggaagaacggctgaaataccagcttctccagtcccagatcaacccgcatttcctctacaatatcctggggtctgtgaatacatgccagtcccttggaaaaatggataccgccagccggatgatcaaggacttgacccgcttttaccggcttactctaagtaaatccggcgaccggatcaccatcagggatgaaatcgaaattgcaaccctctatttaaacatggaaaagctctgccacagcagcgagctttcctgggaaatcgacttggaagacggtatcgagaacttcctgatctgcaaattcaccctccagcccttcctggaaaacagcatccttcatggaatctccaacaggacgcccaacctgttcattggcatccaggccgtctatggggatgacacggtcatcatccggatcaaggataacggggccggaataccggaagaaaaactaaatgagctgaagctggatctgaaaagaaaaaccgtgaattacgaaaagcatttcggcatcttaaacgtcaatgcccgtatttccagcgagctgtacggctgcggacgtattgacatagacagtaagccctgccagggcacttgcatcaccatcacctttgcacagatagaaggagacctggaatgaagaagatcatgattgtggatgacaactgtctgtccgtggaaggaatccaaaaaaatattgactgggaggccctggattctgccgtgatccatatccggtacgacggaacgtctgcgatccaggccatggaggaggatcctgcggatatcatcatctcagacattgaaatgccggacttagacgggatctccatgagcaagcttgccattggcttcaacccctttgtgaagatcatcctcatcagcgcctatgaccggtttgactatgccagacgcgcccttcggatcggcgtttacgattacattgaaaagcccattgactattcctatctggcggaaaaggtccggggcgcctgcgctctcattgaccaggaaaaaaagaacatggagcttttgaaccagagccgtccccttatgacggaaaaattcttccgggacttgatccattattccggaaaggaggccgcctatcatctggcttcctacatggagtacttaaatctgggcttagattataaattctttgccgtgatctccttaagcgttgaaaatgcctctgaacgaaaggccgctatgggtgtggcacagtatgagatcctgctgtacagcatccgggatactctcagccggtattgcaggatctttgattttcactatgtgctgaaggactttgacggccttaccctgattctgtgccagaacagctcaaacccggatcactttctccaatccgtccacaagatcgcctccattgtggcggaggaataccagaaatccgatatttcattaaatattggcatcggaaatgtggtttctgatttatggaacgtacatctttctcatgaaagcgccgttcatgccctggaataccgttttttctttccccagaaaaatgtgtttaacgccagggaagccctgggcaggaacctgactctggaacccttctcagacacaggggaggaggaattgatacgcctcatctgccagaaggattaccctgccctggaacaatggatcaaggagttttcttctgacttactgaaaaaataccagacaaaaaatctggtcttcatccgcatctactccctccttggaaggatcctgaagtttttatatgaattgaacattaatgctgaggaactggaaatcagcattatcaaggcctacagcagccttgatacctttaccaccagcggccagttcttttcctggctgtaccggatctgcaccatggcctgccataagctggacacctcgttaaaggcctaccatgacaccctttgcggctcagtcctggcctatattaaaaacaattatgaaaacagcgatttgtgccttcacgacattgcaaaatacgcaaacgtaagccctgcttatttaagcgccttgtttaaaaagaatacaggggtgaatatcagcgacatcattgcttccgcccgcattgacgctgcctgccagtacttaaaaaactccaccctttccttaaaagaaatcagcgagaaatgcgggtacgccaaccagtattatttcagcaccagctttaaaagaaagcttggagtatctccttcatcctaccgggaggctgaagtttatgaccagacccggctttaacaaaaaactcagggaaccagtaggcatgaagctcaaactggttccttgagtttgtcaagcggatatttgcaatccgctttgatacttgattcagttaaatccatctattttccatcgttcttaaatatgatcttaaagatgggaaagaacacccagaaggaaatcgcagaattgatcagcatggtgatcacgtctgcaatggtctctcctccaccgcccagctttaagccattcatgaagaaatggtagaccggggccttataaagaccctgaagggcagcagcgccgatggtgatgatgatataggcgatcacataccacatggccgcctttgccgcgctgttatttgctttaaaggtgacatttctttgaaggaaaaagttgatgacctgggcaattcccatggtgatctccaccgccagaaaatacgcaagtcctccgcctcctccctgggaaagggcgcctgccccatagttaaagatataataaggcgttccatccagattggaacccacatgccatatctggaaattcgtatccaccagagaggtcatccccagcatgttccggaaaaccggcatcagaatcatctgtaagaccgttactccattggacacaaggaaaaacagtaaaaattgtgctagagtcggatggttcccggcaaatgccttccatccggcttttatacctgacagcatgtgctccctcccttctattttccggagagcttcttctcataagctctgttcgcttttgcattggaaaaatatccgccgatgatctgcttcattccacggaagaaatggccgttcaccgcaaggaccatcccttctgccatttccatgctgaccgctcctcctgtcatcttggcaatcccccgaaagggcatgttataaatgaacagaagatttaagtccggctttccctttgcctcactcctgtttttcagggctgtgaggatccgccaggccagccttgccagcgggctcttagcataatacatctgacagagggcatcattgactcccaactcaccggaccatttcccatcagggaccggatggcccaaaagggcttcaaattcttcctcaggcacctggccgatctttccggaatagtaggatttaagcatttccggctcataaggccagctttccgtggtcccttcccgtgtcacagtctgataaagcctgatgtctgccacgcttccaccgatcaatacggtataaatgccccctccacctcaaagcggtttgtcaccctgttccagtaacggaaggtcttatcatcaaaaggaatggtgaccatcctgctttctcctgcctttaagaatacctttttaaagcctttcagctccttgtccgggcggaatatcctgcccttgggtcctctcacataaagctggacaacttcctttccgtcaacctttcccgtattcataagggtgaaacggacttcattctccaaaatctccatattgtcataagaaaatgtggtataggacagcccaaagccaaagggatactgtactttaaccttttcagtatcataatacctataacccacataaaggctttcccggtactgggagcagcgctcttctcccggaaagtacttataggcaggagtatcttcatatctccggggataggtttcgcttaagcggccggaaggattcacttctcccgtgatcacccgaagcatggcagaaggacctgcctgcccgcttaaatagccgtgaagaatggatttacagcattcatgccacggcatttctatggcagagcctgcgcttaagatcccggcaattctggaatttacctctgccagggccgtgagaagctcaatctggtttccggggaccctcatatggctccggtccattccctctgattcactgatctcatcaagtccaaagcagtaaagcaccacatcagcccgggctgccagatcaagggcctcctgccttaaggcagcatcatctgctccgcttcgggaatagcctctggcacagcctatgacatttaaggggtaagcccttatcctctcctccatggtttccaggcggatggggtttaccagggaagaccctgccccctgataccggggtgtaaaggcaaagtccccgatcagggccaccctgcctccgggttttaacggaagcatttcatcctggttttttaacagcacgatgctctcttgtgctgccttttccgctaacatgtgatgcgcatcctcatcaaaggagctttgcctgttttcctgattcccggtaagggtaaataccgcctccagcagatcatccacgcaggcatccagcgcttccatggataggctgccattttccaccgccttgatcagttctctggccgtatgaaggccgggggagggcatctctaagttagagcctgccgccacccccttcacatggtcgttggagccgccccagtcggtgatgacaatgccgtcaaagccccactctccccgaaggatatccttaagaaggtgctggttctcattggcatagaccccgttgacctcgttgtagctggtcataatggctcttgccttgccttccttcactgctatttcaaaaccttccagataaatctctctaagagtcctctcatccaccacggaattcattgccatgcggcgctgctcctggttgttgactgcaaaatgcttgggacatgcgtgcactccctggctctggatcccctttatataagccgccgccagctttcccgacaaatagggatcctcggaaaaatactcgaaatttctcccgcagagaggacttcttttgatattaaggccagggcccaaaaggacgttcactcccagagccgaggcttcctctcctaaggcctccccgatctcccggcaaaggtcttcatcccagctgtttgccacagaggctgccgttggaaagcaggtggacggaagggaggcatttaagcccagatgatccccttcctttgcctgtttccgtattccgtgagggccgtcggagcaaaatatggacggaattcccagacggtcaatgttccaggtctgccacacgttttttccgcttaaaatggccgctttttcttctattgtcattttttcaatgatatgggtatgtttcatgttaattcccgtttctttttatagacattgaggatccttacctccagaacaacaaatcccgccgccaggatcacatcaagggcaatggcagccatctgccatggaagcagtccgccctttgcgttatctccttcataggcacggctgtttaccactgtgtacatgatgtttttgcttgcctttctcatggccagaaggcttgtggcgctggaagtatccttcacatggttggtttccgtatcataggcgaccagcatggcgtcgtttccgttccggatttcctggtctgcgttctgatatccgtagcctccgaaataatctgtcagcacaaagccgcggaagccccattcatcccggagcaccttattaagcagtgcatcggaagctcctgcatattctgttccaatgtagttaaatgcggacatgactgcttttgctttgccctcttttactgcaatctcaaaaggctttaaatagatttcacggatggcctgttcatttgaccaggtacagagcatgttgttccggttggtttcctggtcattgagcgcataatgtttgatataagcatacactccatggctttctgcaccgatgatggcactggccgccatttttcctgccaggactccgtcttcggaataatattcaaagtttcttcctgcaaaggcggaacgatgggtgttcattgccggtgcataccagccggacaccttcatctcatctgccatcttaccgatgctttccccgaattcctccgcaatatcccggttccaggtgcttgcgatcatgactgcggatggaaaaccgatggacccggtccctgtaaagttattgttaatggaagccggtccgtcacaatccacggttcccaccttattcacactctttgctgcggaagtctgatatcctccgatggcgatcatggtatccatttccgtcacggtcagctgatccagaagattctcccactggggatcgtcataatccgcaccgcgcatggaggcaaggcttaatccgttgcgggcaccggtcaccggcatcacatcctccgcccggttgtggaccgccggatcatagttgctgttattcacaaaagcagccttgtatgcttccggcatggtcaggctttccggctttgccgtagccttttcatagtttgcaaatccgtctgcacgggataaataggtcaggcctccgtctgcatcggcaaactggtttgcagcagccgtctcatcagaagaacggggattggtttcatcgtatacgatttctccggctacggtatatgtctgttctttgatgatgctgtgggaatcagaccggatagagatcccgtaatcccctgcttccaggacataagttccctttccggctccatcataggatgccatgtcttccgcctggaaggatattgcaatggtctgggactgacccggctccagaagatccgttttatcgaatgcgattaagttcgcggaagccttttcaattcctccgttggtataaggaggattgtaataaacctcaaccacatcctttcctgccttatcgccagtattggtaacggtcacatcaaaagagatggtaccgtctgcctctgtaatggcgcccatttcctgagagaaagaggtgtaggtcaagccatatccaaagggataaagaacggttttattgtagtcgatcagcccttcttctgcggcagtttcataaaaacggtaccccacgtagatgccgtccacataattgataaagctgggataggttgcttctcccttaaatgccttgcctgcgaattcactcatgttatcgtaaacaaagcttccaaaattattgtaatggggggttgcggttaaatccgtcacaaaggtatcacttgctttaccagatgggttgaccgtaccgcttacgatctcaccaagggcctcaaagccggactggccggttcccgggcaccagatggcgctcttgatctggctgtactcattgacaaagccaagctccatggcattggctccattgtacaccaaaaccacattgtcgaaattggagcataccagatcaaccaggtctttttccgttttgcttaattgcagataatgctcaccaggttcaaagtccttatattccgtggaattatccgtataggtaactgcactgacatcagtaggaagatcggctccttccccgcctacacgggtgatcacgatcatggccgtatgggaaaatgcctttgcctcctccatcagctcactggtataggatccctttacaggctccggaagggtccagtcctgttcccacatccccacattggggcggtctgcccggtatgcggcgtagaaatcagaaatccctgaattcagcttaaagcctgcgtgttcaagcccctgaagaagggacacggtttcatatgcgtcagagagagaacctgaaccggtaccgccgtaacacggattggtggaagcccagccaaacacgtttaaattagaatcagattttaagggaagcagattttcttcattctttaaaagcacgatcccttcttccgcgatcctggtacaaagcccggttgccttgtctgaagtctcttttgaaatggttccgctgcctgttgcaagggaaatcagactggacatggggccccagcagatcatgtttgccacaataactacggaaagcacaatggccataagcccctggcaccggatcagatacctggcggcagctttcttttttctgcatgccaccattgccgcaaccgcagctgcaatgacaacggccagcccgatcaagtacggcacgcaaaggttgacgatctttaatacatcatccatgttgatttgtaacatttctttcatcctcctccataaaaattaccacagattgtgtggtacgcatctcactttaacacattatggacttgggaaacggctttttgcataaccggtattattttctgcataattggcaggcggcttgtcctgtttaggaggtttagtaataattttctgctgcaataagagcctcttccatggtatccttaaaaattggttcctggtactcaacggttggaatttttcctttcccttcatactccagtattatgctttctgaattatttccgatacttcccttattctccaaatttaaccagaaaatataatcagagcagccaacaccatgaataatacaattattacaagtataaaaagtcctatgtatttaatattcttttcattgtcatctccctttggctattatacaatgctatactctacatagtagacctaaggatgctacagcaatggaaactaatgcaaccacgccaacacactctaccacaatatcccatggcgccattgttttatcttttgaaactgaccattcggaagttttaagtatatcaataaatactcttcattatagatcctatatgctttctgccccaaagcattgagtatttacattaaatccccacagctatcatatgtacacagtgtcacattctcgcttttaactgcataacaatccttaaattccggccatttcactatttttcttctatctctatgtcaaattccgaacttggtttatcactaattaaattttcgtaataccagaaataatttttttctccataaagtgaaaattcaataatttcagttggactctgtccttctatttttagttgattcacatctacagtatcaataccaccaaatatgaaacggtctccttcattaattccatattcactcaaattaccaatatcaaatgcttgtatgtactgacaaaataggctaaattcttcttcaggcgtcattttatttttaccatggtcaccatatcccatgtgcattgtataaagtagtgcatattgtttcttactgtttgtagtttttacaataaacttagctccaacaaatgcaccttcctttgaatttttatcagataaataaaacattgtcgaatatttatcattttcaaaaacttttatgatataactcacttgatcaatatatttatcatcgccaaaataaagctcatgatttaccactgcaagtgcttcttccatgctgtctgcaaaaactggtacctttttctcaagttctggcatcttttttccctcaaactccactattatatttccagaatcacttttagtacttctattattctctgagctaaacgcagaaaatataatcaaaataaccaatatcataaataatcccagcattgcaagcataaagaatcctatatattttattatccttttcattaatatctctctcctgctaattccggtagtgtcaaatttcactaccattttttattgttaagccatggttctatgggagtttgcaaataaaaaagcaatgacctccattttttggtataatattaatcaccaaagcaatcataagaatataagatgaggctcccatatacatctgttacgccaacaggatttcctatatcatcatattcaattgttgattgattcccgtagttatccattactttgattacacggttattactattgtattcataagttgttacgagaccatctgcctctgttttgccgataagctccggctcctaccactaccagaccagaattcttcagccattccaatacgtcttttggcactgctaccatttcctcctgcagttgctttttcctgacctaatatgaccagaagatcattcctagatagtttttaacagtatggtaatgtatcctgaacattcacatatttttctcctcgcattttctccaattctttctttagcagctgtagcatatcctcttctgacaattcatccgcattatgctgtttaatgaatttccgtgccaatacagaattctctacatataactttttatgcatttcaggagttggataaagccattcttccatctcttttatcttcgctcttgattcttccgccttttcctccagcttcttcaatccgtattgttcaaccaaatctaacagcctgtttaacacagcaatctgttcttcttcgttatgaaagggcaggaagtctaatttacagtttggatcaccggttatttcttgcgatctgccgaaccaataaccattgtccatttccaaagtataatcatttccatggtaacttttctgaatcactacgctttgaatcaatccatctacctctctgctgaatctccaacgatatccttcataatccgcatattgaaaaccgtagggagccaacctctttttcatcacttcaattacgatactcttctttcccattctctctctccacgattatacataaacatgataatcacattggcggtactttccatttcgcataaccggatgttggttgccaatcttccccatgcgattttctacaagttcttacccatttaataattccattacaattatcataataataatttagtattaattcaacgtcttctctttgccatatccttaccaattcctgtaatacatcacgccaatggtataaagttatatctacgccagataatccatcactttctgtatatttccaacgtccacccacttttttataaacatattcccgtataccgaagcaagctctattaatttatcctgtacctcctcatacggctctcccttgactttttctaattccttttttaacagcaagagcatatcttcttctgacaacttatctgcattatgttgttctataaacttttgtgtcaatacagaattctcttcatataactttttatacatttcacgagttggataaagccattcttccatctcttgtatctttgctcttgattcttccgccttttcctccagtttcttcaatccgtattgttcaaccaaatctaacagcctgtttagcacagcaatctgttcttcttcgttatgaaagggcaggaagtctaatttacagtttggatcatcggttatttcccttgatctaccaaaccaataaccattgtccatttccaaagtataatcatttccatgataacttttctgaatcactacgctttgaatcaatccatctacctttctgctgaatctccaccgatatccttcataatccgcatattgaaaaccgtagggagccaacctctttttcatcacttcaattacgatactcttctttcccattttctctctccccacgattatacataaacataataatcacattggcggtactttccatttcgcataaccggatgttggttgccaatcatccccatgcgattttctacaagttcttacccatttaataattttattacaattattattataatcatttagtattaattcagcgtcttccctttgccatatccgtaccaaatcctttaatatatcacactggcgtaataatgttatatccacactagtaattccatttaaaacactatgatcccatcgtccacctaccttttttataaacatatttccatatacagaagcaagctctattaatttatcctgtactgtttcatacggctctcctttgaccttctctaactccttttttaatagcagaagcatgttttcttctgacaatttatctgcattatttttctcaataaacttttttgtcaatacagaattctcttcatataactttttatacatttcaggtgttggataaagccattcttccatctcttttatcttcgctcttgattcttccgccttttcctccagttttttcaatccgtattgttcaaccaaatctaacagcctgttcagcacagcaatctgttcttcttcgttatgaaagggcaggaagtctaatttacagtttggatcaccggttatttcctttgatctaccaaaccaataaccattgtccatttccaaagtataatcatttccatgataacttttctgaatcactatgctttgaatcaatccatctacctctctgccgaatctccaccgatatccttcataatccgcatattgaaaaccgtagggagccaacctctttttcatcacttcaattacgatactcttctttcccattttcgttcctttctcaaacactgtgtttgattcatctgcttactccgatatattaatttactgctgggcaactgccaaatacttgtgtaaatatttgtgctgcttttgcaaaaagcgccacagcaacgccatcatcgaatcctccaacaccagtaaaatcatctgctattaaaacaccccctgctattactgctccgactcctaccagcactaggccagcattcttcgcccattccaatgcatcttttggtactgctactatttcctcctgtggctgctttttcctattctcataggaccagaagatcattccgggatagcctgcatctgtatggtaatgaataactttatttggatatcttttgctgggaacatcgcagttaaatatagcatttaaggattcccccggtattgcagtccttcccttatatcttttatcagcctgattcctagttattgcatctacatatgcattcaactgcacttgtcttctggctctactataagccgtagatggggaatattctcatgtctgcgcataataggtcccgctgtctcggaaacacctactacgaagcataagcaaaacgagtcagaactgacagcatatataattgatatatttaaggctagcctatagtgtacttttaattttactcttcctccatttctatatcaaattgtgaacttggtttatcactaattaaattttcataataccagaaatattctttttttcccttcaccatatattcaatcacttcggtagggctttgaccctcaatttttatcgtttttactttttcagtaccaaaactgccatatataaaccgatcacctttgttaatgctaaactctgctaaaaaatcatataacggagctgcatcacgcatcgtctgtagcggtgtcgatatcattggggttcctttttccgtaagatttactgaaatcagagcatattgcttttttccatcagtttctcttactttaaatttactggcaactagtccttctcttttagaatctttaatggtatggtaaaacatagttgcatattcatcattttcaaaaacttttactatatcattcaccttttgcatatagggataacgtttaaaatagtaatcgacattaaaagtaagtgccccctccattgtatccgcatacactaagtccggtgtttcaaaattgggtgtctcccaatttccaccttcatccatccttatatttgccagattagtttcttttactttactctggagatatgttaatgcataaaaaacgacaaatgcacccattatcattaaaacaaatacacttaaaataataagcatatacttccttatatgttttaataacttcatcattctgctccattttttattttcattttttatcaatatgttctgataatgctgtttataatattaatccccgcatgcagcaattacatagtttcatgcttctgcaattatcgctatccctcctgcaatcaatcccccaagtgcaacttcctgacctatatccgtcaaagcgactactcctgcagttacaacacagacacctccaattgcatccctgggcaggatttgttttatcttcagatattgaccaattaacattcgtatgggaatcaataatcacaccattaggaattggaatcggaatattatctatcgttccacttatctctccgttaacataacagcttcattattatacccatatcctgccgaatgacttaatttttcattcagctttttcttttcaaaatagcataatgttttccatgaatttttcttaaaaatacggttaccaaatacatcatatgtatattcttgtaactcttttctgttccttaatactttggtaatttggttcagaggattgtatttgtatcgttctgggaacaggcttagtcttctggtcccagaaaatattctttaataatcgtgtctacttgcttgactattgttctgttattattctttactaaaatgtcttttaatttttactcttcctccatttctatatcaaattttgaacttggtttatcactaattaaattttcataataccagaaatattctttttttcccttcaccatatattcaatcacttcggtagggctttgaccctcaatttttatcgtttttactttttcagtaccaaaactgccgtatataaaccgatcacctttgttaatgctaaactccgacataaaatcatatagcggagccgcagcacgcattgtttttaacggagtcgaaatcattgcccccccatttctgaaagttctactgaaatcagtgcatattgcttttttccatcagtttctcttactttaaatttactggcaactagtccttctcctttagaatctttaatggtgtgataaaacatagttgcgtactcatcattctcaaaaactttaattacattgttcactttatgcatatatggataacgtttaaaatagtaatcaacattataagtaagtgcctcctcccttgtatccgcatacaccaagtctggagtttcaaaattgggtatctcccaatttccatcttcatccatctttatatttgccagattagtttcttttactttactctggagatatgttaatgcataaaaaactacaaatgcacccattaccattaaaacaaatacactcaaaataataagcatatactttcttatacgttttaataacttcatcattctactccattatttattttatttaatatatattgataatactgtttataatattaacccccgcatgcagcaattacatagcttcctgcctcagctataatcgctccccctcctgcaatcaatcctccaagtgcaacttccgggcctacaaccgccaaagcgactactcctgcagttactacacagacaccaccaattgcatcccatggtaagattgttttatcttcagatattgaccaagttacattcgtatgggaatcaataatcacaccattgggaattggaatcggaatattatctgtcgttccacttatctctccgttaacatagcagcctttgtcattatacccatatcctgccgaatggctcagtttttcatccagctcctttttttcaaaatagcataatgttttccatgaattaggattcatgttttcaccagaaagtgtaaatccagtagaataatttgtggtggggatttctatagatgcatttaatgaccaccctgaaaaacgacctttatcatttctatttataactataatttctcctccagtatgagattgtaaagtaaaggagccctttttataaatatcagtatccaccccataaatttcattccccagaattcacttactgctgtcgcagcactgctgattccatttccaactgattttcctatatcatcaatggtattagatacatcatccttccaggaattaaaagctctttcatattcgtccagataataaccggatatatattgatttgcttctctctgcgtaaactgtccattaatatccacccatttacatggatttccccaacaataattatagtgatttaacgtttccggcaatccaacaatgtcatttacaatatcctcactaataaacgaacctgtagatggacaatactcccttgcctgtgcataataggtaccgctgttttcatcccactgataaccggtaaaaccaaatggctggtgcgctctttcatttttataggtgatctctccaaactcactgtatccataaagacctgcatccctgccattactgaaacaggtacggatagtgcttcctaattcatcatttagatattatttctttccacttttccctgtagccacaacaatattgttatcccatatatattcctctgcctcaccgttttctatcttttccagcaggttattacctcttttggtaaaatccaaaatatactcgacatccgttgaaatatttccatcagaaacctgtttcccaattctatgtcctaaaccattatattgataagtatggagtacccccttctcatcggtaactgtctccatgtgattacttataccaaattcataactcctgcttattatgccatctacggatacagttcttaaattccctcttaaatcatattcataatcttttatttcctctcccatttcccttattaactggttattggcattataaatataattagtttcaatttctccctctttcttaaaaatacggttaccaaatacatcatatgcatattcccgtaactcttttccgtttcttaatactttgataatttggttcagggaattgtattcgtattgaaaatcgccactttccaatggtattcctgttcgttgtttgttaatacccgtcttgtttcctatcggatcataagtataatgatattggtctaaaatcttttcatgatctttattaataatactgatcagctgccctgcctcattataggaataattgacctttaatccgtttgtaaaaaattttttcctgcaataacccgtttttattgtatcgataacctacattttggattccatctgccagattagataaacgtaagcactcatcatacgcgtacttcacattcttcccatttggataattcatttgaagcaactttcccctaggagaaaactcataggaagtttttcgccccttgtaatctgtaatggatttaagatgctcataaacaccccattctacttttgtagttccataccagtcttctatttcatttagccgtcttaaaccatcgtatttcagtgttacctgtttgtcatctgtatattttatattttctaacaaaccagcgagagaatatgtaaaacagctttcacctccatctctgtccgtctttttaattacattaccatttttatcatattcataatactctgtatttcctaatgcattggtaatagcttcaatctgcccaagtaaatttctttggtaaagatgtgtttctgattcctttccacctagcttcatggcagaaagaagtttccccatacaatcatattcataaaaagtactattgcctaaggcatcaattacttttgtaatgtttccattaagcgagtattcaaatcgagtaattttaccattggcatttaccattgatgtgatatttctatttttatcatataaataactttttttattgcccagggaatccgttactgcaatacatctgtctaggcaatcatacgtaaaattaacagtaaaactatcttgattttttatctttgttatattccggtttccatcataaaaaaactctttacttgtaccgtcgcaatactgtacctttttcagaagttttccaggataatagctataatccgtctttctgcccgctccatccatcttatttactatttgtcccagacaatcataggaaaaatcactgcagttcccatatacatcggttactttcgcaggtcttcctgctaaatcgtactccgtcaatacctcatttccgtaattatccatcgtctttgtcacattattactagtatcgtattcataatttaagataaatccatctacctctgttctgcttatcagtcgatttaaagcatcataaacatatactgtttctgctccattgggttccgcgacctttatacagttcccattgggatcatgccagaactttgtagtatttcctaatggatccacggctgtttgtatatgacctaaatgagaataagaatacagataagcccccccattagtgagactctttttaaccattttccccatactatcgtattcatatgaggtgacattttcctccggatccgtatatttacagcagcggctgcacgcatcatactccatttggtgaatactgttgtcaaagtcctttatttcaattattcttccgctgtcattgtattgatacctccgtttatccctaactgcattcgtaatttcttccagcttaccagcattgttataagaatacaaagtctgattcccatttccatcaatgtatttttcctgctgacctaattcattgtaaaaaaaccttctgcaattttaatttaacattgcaccctattcctctatttctatatcaaattccgaacttggtttatcactgattaagctttcataataccaaaagtattccttttctccataaagcgtatattcaatgacctcagtagggctctggccttctattttcagtgtctttattttttccgttccaaaacttccgtacacaaatcgactacctttgtcaatactaaaaaccgccaaataatcatacaatggaaccatccgacgcatatctaccagtgataacttttgtctatgtcgtccttttgtcatctctgtactatccaaaaaaatcaatgcatattgttttcttttgtctattatcctcactttaaatttagctccgataaaaccttctttttttgaattactaattgaatgataaaacattgctgaatattcatcattctcaaaaatttttattacatcacttaccacactcatataagggtattccttaaaataatagtcagcacttgcggcaagagccgcttccatagtatctgcataaataagttctggttgctcaaagtttggcatttcaccagtaccgttatactttattatagcgtttccagatccattcccttcattctctgtacttaatgcagacaaaatagtcagaacaaccagacccacaaatattcccagcacaataagcgcaaatatccctatatatttaaatatcttcttcatcaattgcctctttgtcctcaccttctcatatattaattaaataatcttaccacataatttttattttcaatattatgctccacaaaaaaccaaggaagctcctcctgtttcaggaataagcgctatagctaatgcaagtaataatactgttccaacacattctactactgtatcccatggtgctattgtttcatctttagaaatcgaccatgttacattggtataagatcgaatacttactccattagatagtatcaacggcaatttatccgttcctcctccccaactttcgttataatatactccttccactccatcatagataacctttcctgccacattcaccccattatggacggatttcccaatattatcaatcgtactggaaatatcatctttccaggcttcaaatgctcttccatattcattaattaagtaatcagcaatcagttgatttgccgcctgttggagaaaacgtccgttttcgtcaatccattgattcggatctctatcgcaatacgaataatgattcattgtcttcggaagcccaatgatgtcatttatactagtatgccagtaaccttcagaacaaatataacagggagaaacaacaagcgaaagactgagggggtacaagaacgtgtttcataaccccatcggtgactttcgcagaaaggcggatttataataatggactactataaccgttacgggttggaatttaatcccttcctcaagaactccaaagaacttatcgtaaagaccaatgaatacagcgaggttcttttccgactggactaccttgtaaaaacaagaggctgcaggccgtcaatgactgtgaactcagataagcataaccttaggattttcttccctaattaatttgcgggagaaaatcctttcttaaaataaactgccaaaacagccaccactaaagtgacgggattacctttttgtacaatgaaataactgaaaataatctgtcggataaagtatcgtttaatttgccaaatgacagtataggtatttcccatggaattggtaaaccaccgcagtttcccatactggtatttcagactgatttttcttccggtatgatcctccacataaatcagttttctttctttgttataggtataattcagcctgcctccagtcccattatccacacattccaaaagtccgtcactgttgtaagtaaatttccggttgtttccattcctgtctttctggctacatagccttccctcctggtcaaactcataaacagtgccatcttcccgctcaaaccggtagccgttttctgatttgcttagtattcctccgtctcccataaccggagcataactattccccagcttccggcagtaaggcaactcccgcccgtcttccaggacaattcctaacagttcttcctctttgatttttatcagacgaaccccgtaattatgattccagccctctccaagtacctgctggtcgccgcaatccatagcattatagaacagctgtaaacttaacggcagattcccatttatcactaggtcctctttttcataaatcagcaaagaaaccagtcattgtatcaattagcttccgtggagaagcaaataatccgaattactgaatttcttctatctctaaaatcccatcataaaacatcttatgtctgatacaatagtatatcaacgctattggccaaagcgcaccactcgccaatattttcaataggctatgtttaatagcaaaccctattgtatcttttttataccttaaatttaatttaacaatctttttcccaaaactccttcctttaaaaaaataatcttgtacgaaaatatataaaaataataatatacaatagacaacaagccagccatctgaaatctgaaataccgtatctatatacttcataattattccaactggatataaagaaaagataatggtgtaaattatggaaaaaattacgtaatcaattattgttgcaaaaaagcgcttcatagtttttcctctctcaattaattgcttgcttcacatttagtagcattacttgggttggcaacaggaccaattacaatatagggtatcgtaggatcctttttattacctccatcggtacttcttgactcgcctttcgttgcattgctaggattggcaactgggccaataacaatattaggtgttgtaggaatctttcttccaatggcactgagatttatatccaaattgatttctcctcccactccaagataagcacctatactattacttaaaataatgtctttttccccactatctgtacctattacaattcccccaatttggacatttgcatagactatattttctttatgttttcctgaagaagcgtatcttgttcctgttacacctacctcaccattaagaaacggagttacgtctacagcaccacctaaatccatggattctgtccactcgtttacatccaaactatcaaaagtataataacgcaaaagccctaattcggcaccaaccccaagcacttttactttagcctttgctcctgtaccagcgtttatagataagtgtaatatttgatctgatttctttggaacttctggctttttaccatttaaatcaactaaattgatggaatttccccaacagtattcataagaattcaaagtaaatggctgttcaatagttccttttataatatcctctccagcaaatctcccaattcccggaaaatattctcttgcttgcgcaaaatatgtatttgctatgctgtcgctttgatatcctgtatacccaaacggctgaacatctccctgcgttttatacaaatcctgtccaaactcatcatacccatatatagtctgatgtttatcctgaatcccggtcaaacgaaccgtacttcccagctcgtcctgcagaataatatacccatgttctctttctgtcaaaaataaaacattgttgttatcccagacataagtttgtgagcccatgctatctcctgttgtctctgtcttttccagtaaattatgataattcctggtcaaatccagaagataatccgtttctctcttcggctgttccatcaacagcatttccgcctgaaggccgcgatcagactctaaaacagaaacatcaaattcgtgtcttccaatccggttccccagcccgtcataattgtacctggcagcctgtcctttgttattaaaagctgccgctaaccggttcgtctcatcatatgtataccgattggactcttccagtccataaagaacagcggtcaaatttcctctatcatcatactcataggatggttccgggaaaatcccctcctcacaaatcagttggtttgccgcattgtaattgtaacgaatatttcttgtccctgcctgctttctgatccggtttccaaaagcatcatactcgtatcggcttatacgctcccgatcctttatcacttctgtaagccggttcatcgaatcatattgatactgataaaaaccactctcctcctgaactatcctgctcatttcccgtgaaattccatctgaggaaaaaacatcagcctgccgccgcttccttatggaagttttatttcccataagatcgtaatcgtattcataatgatctagtatcttcccgtcctgttgatgagccaggctgcttagctgtcccatagaattataaccataactggtgactattccgttgggaaaaatcttttttgatagatagccattctcatcataagaataataaatttctctctctccttctgtcagtctaattaagcgaatcaactcatcatattcataagatacggttcgtccatctggataggtcaacgctttcctctctcccaattttccccactgataagacatttcacgtcctttataatcaatgattttctttgctcttccaacttcatcaggctcaatcctagttgttcccagccagtcctgtatttcaatcaactgccttaaggaattgtaagtgaatgcaacgctgcgtccgtcagaataggtgacatgttccatttctccctgcggattgtaagtataattggtttcatatccttccccgtccattttcaaggtcatttttcctgccaggtcataggtaaaatgctccttaatgccaaggggattgataattgtcttaattttcccaagcacattgcgttcatattgagtcacatggatctgattttcatcaagaatgttcttcccacggaaagtctcctctccatttaacaggaccttctttccctcatgctgacaaatggtaaccaattctcccatatcatcataagcatactccgtccggtttcctgccgcatcaatcactgaagtcagtttcccacccggagagtattcataatgggttacatgccccaaggggtccgctatggaagtcacttttcccgcagcattgtatgtatagctcttttcctgtccaaaactgctttttacccttattggctggttcacacagtcataggtaatttcaagaaaatcccctttatggttctggcggcgtatcagattcccattattgtcatacaaataggcttccgatgttccatcgggataaataattctggacaaatccccgcccttggcatattcataaacggtctgtcgcatctcaggatctgtcctacaaatacattttcccaattcattatactcataacaggtcttattccccagaacatctgtctcactgatcatctgtcccatctcgtcataaacataggtatgagattttcccatggcatttgtaattccaattaaatgcccttccatatcatactcatacctggttgctgcaccagaaggatccgttatttttgtcatccagttccgttcattataccccatgactgtgcggttaccattgggatctgttaccgcagtacggttcccattggaatcatattcataatgaatggttcctcctgtgggaagtttgatctgttccatacggttcaaactatcataagcgtaagccagttctcctccgtttggcagaatccggcgggttacattctgcagctggtcatattccatagtgaatttctctccgtccggtccagtataagcttccaccatattcatgcaattatagctctgactgataacggctccattaaaatctatgatttttttcacttttccatttttcgtgtattcataaatacgccgtttcccttgtgcgttaataacgccagttatcctgtcacctgtatcatattcataacttgtactgtttccattcccatcaacagttcttactatcctatttaacgcatcataaccatagctggttgtattcttagacccatccataattctagaaatattactatgctcatcatattctaggtagatatggcttttatctttttgaacaacctcctttactctaccctgcgtatcataaataaattcctgttctcttcccaatgcatcctccatatggagtagatttcctttgttatcatatgtgttttttattttcattacgccatttacggataataccagtaggcggttattcgcatcatatgtcatgctatgtttacaaccgtctggatagataatctgggacaagtttcctttatcatcataagctaattttatcatgtttccgttcttgtcgacatacctagtcaactggttcctgtcattatattcaaatgtttcctctccatcctcatagatggtacggatattacgcattttcttatcactttcatatataatcaggttcccattttgctctttcatgtatgtacggttattcttatcatcatagcgcagttccactacacctccatccggcagtgtctgcttcaccacacggtcacccccgtcatattcgttttttacgcctacaatatttcgaggtgtcacaactccattgagctttccattctcgttataatcatatgtataggtacagccgcttgaattgataaaccagcgaagtttaccatactgatatcttaagctcacctttcgcccggtatggtcctccacataaatcaggttcttttccttgttatatgtataatttatctgaccgcctgttccgtttcccacactctccagaaatccatcctcgttatacataaatatccggcggttaccgtttttgtctctttgggtacacagcctgccatcgcagtcgaactcataaacagtcccttcctccctctcataaaaatacccgttttctgacttcttaagacttcctccatccccattaccggggcgtactttcccccagttttcggcggtatggaacctcccttccatcctccagaacgatacctaataaatcttctccgacaatttttatcagacgtactccgtaattatggctccatccctctcccaggtttccctgatttccacattccattgtattataaaacaacttaaagcttaaggacatagtccctttgatgacaagatcttctttttcatagatataattacccgtattcatattgattggatccttgccaaagacatggcaaagcatatttttcccagagacccagcggaccacgttctgataacgcttcaggaaggcagcccaattaattttcccatcataaccctggccggatgtgaccggtatgatgattccgccttttttacacaacagaacggaactcatactaattgcttcttccccaccaactatttcagcctttgtggctgacactgcagtattctcccatttttccactaaatccataaatccttcacattgatgggtattttcatttttcttacattcaccaaaataaggaatattaacacatgccttacaatccttacaattgaccttttgctttccaccactggtatagttatggtttttcggtaacttaagctgtgtaacacagcttccattcacacacatcagtttggctccctccaccagatactctttactgtctacggtcttctgcacctgattgaaaaccgctccaacccccagtccagaattcagtttccctttttcactcatcaaagtttctccttaccttatttacactttttccgatcttctatatctgactaacccatccatctgtcaaatgtacctctttcagttccattccaacaatttcccgttccagcaaactttccgctaagtccatgcgtatgattgtcgcgctctccagccctatccttacacgaaacagaggaagcccgttcatttttcttctgtccagtataatcccgcgctgtccggggcctggttttcctgccagacactcctcttcttccagcacaggacagtaataggaggcacattcccctttttccgtatcaaatagtacaataaacaaaaatggaatatttaaatcatataaagccgtcacctcaatagctggcctggaaagcaaaagaaatggcttaacaataacatccggaaatatcccgtcaattccaagtttggcattaagctgaaagaaaggcggtatcttctggtactcgtcccgtgtcagcttccttacatcaatggtctggctccagtttatgatctgcggaaaaggatttttatctccgttggtcaatataaaatatttcatctttccttcatacgccaaaggatctccccctctccctgatatcttccgaaaaaggcaataaagtgttctgcctttactgccttttgaaaagcttccgtttccatgatctctcctgccaggtcaaagcacagctgacggacagccgcatagtaatattccacacatttcctgctgacagcctcttcctcatacctccagatcctggggtagtttctgcgtaagcctgtcatcacggattccatgtcttcctcaaagcattcaaaaaagcagggaggacgccagtacagttctgccggtgccggatcaaaatagaattctctgtcatacagggacaacaggaattcatggctgccagtctgaaggctggtgcagagatagcagatccccagccatgatacttctttctgcgtttctaccgcctgactgaataactgtacaaaggcatccaccgcttcatttctgcattcctttttccggtaatccatctccagcctgcggcactgggaagcaaataactcttcctctgcactttgggcggccctctccaattcttttatccggtccatcaatacccctcctgcttattgtactctgaattctccaccggtaaatgagatgccctggtcaatatcgatgctggttgtcttctgtttcagatttacggaggttgtcccggctgctatgagagagccggtttcgctggaaatcgttaagtcgtcctttgcttttatcacgatgtcatgctggctgacaatctgcaccccttttgcatcatttaattcaattttcgttccctggttattggtaattacaatggaatccggtgtaaaacggacttccttgtggtatttattcttgatgatcttgtgctccggatttttccggtccgggcttaccgtatccaaatgaacggagctgaccacataagcctcttcttccctttgttccggtatatgcagccggaccacatcgccgatttccggcatacagtaccagccggtcccgtcaggagcagaataaaccgtagcgtatggataccacagattgatattctgctcctggttttcatcctttaagacctttaccatcactttatcctctttcaccttcaggacctctgcctggaaggaacatcctgacctgtcttcctggaatgtttccggaaagtccatgccggacctggattttaaatggcatgtatgaagcatttctcctctctcatatgtgctgtccattttccagacaaagagtttgaaaccgtttactgtcagctggtccccgatctggtaatcctcccggctctgtaggatgtattccagacaggcctcttcctgcatttcccgaagcccctgattccgttttctgcggtagcctcccagatcctttttcactgcatatttgatggaatctggaagttcataatgctcaccctccggtaaatcataaaaatatttaacaccgtatgtcctggtgcttggcacaagaaagctgtgaaatcttgctgctatccgctttaaaaattcccaatcagtttctctgtgctgcagcaccagttttcctgtagtgtctgtgagcggccgggttttgatgagccctggtttctcataagtaccggtgatctgttcaaagatcttttcatatgtgactgtactgtcctgaaaggtcctgaaatacggttttaaatccataaagcaggtacccgtagtgatctccagggtcatctttttctggtccttcatgctttcaatcgagaaaccggtaacaattccccagaaaaggatctttgcttcgccttcttttcctacttcttctattttttcccatacgtctccggtcagctgctttacataaatttcttcatcctgatctgctatgtatccgcttattacagctgtgccatgttcattaatttctctgctgaccttaagttctctgatctctataaactgtaacggttctgttttaagattgtattctttcatgctcttcctcctctgtctgtatcgtcccaagcatggtaaggattttcggcttccatctgtcgtagtccttaaatatgcagtaaaaagttcctatgattaatttttcctctgaaaggaacaggaacatcatattataaacccgttcatcggcggcaaagcttttgtagtcaaaccacaggacagggcgttttccagatacgtttccctgatcatagaaaacgttctttccgtctgcctgtttcagtatctggcaaattcgttccctctcagcttccagatctatcacggctttaccaccttccagtcttgcagtctgaaaagtaagtcctgcgtgttcatgaggattgaggagaaacatttccggcctgttcttggaaaagaagacagacgctgccttttcctttccgatctcttcaaaaccaccaggtatcttcagcacaaaacccggaccataaaactcaggccagccagacggttctcctccccgcctcttcgctttcggttttatcctcttcagctccttctttatttgaagaaaaactttatcaatatcatcatcatgaacctcttccatccagtccacctcccgacatatcctggtacactatgttgtttcatgcagcgtatgaaagaaccgcttcaacagaacctcccatttcatgccatcctgctccggataggtagctgtagcaaggaacatttggttacgaactgacaggaccgcctttgtatgttcctgcttttctccaggttcttccagttccatagtaaaccagccggcaggatactgcccggccacatacaaatggaccggtgacagctcactccttggatgtctgctgctgatatattctctgaccgcctctgctgcctttctcgtttcttccggccttagctttttatcaatccgctggaatgtcatctgattttttccatccgcatctgccaggatcatttccgggcgtttatcatatgggtaaaacatctctttcatgatctccggcatctgcttaagctctgccgggatctctgccgataatattccatcgatcaacacaatttgttccatggcaacccgttcctggagacacccttccgtatcctgatcatacaatatgttcatcatacatacaccttattcattcttttcctgaaagctgatggcaaagtcatttatgatctgcttcctattcttcaagctttgctgtgccttgtcctgctccgagcggaataccttctgttcaagcatggctgcggcatccaactggctgctgattgcattcaaccggttaattttttcaattgcaggacttttccccaccccgccgctttttatggttttactcattttttgtctctgcctcccttggtttttccctatctggtcttcaccatatccacctttgtccctgttatctgctgttccagcccggcagagccggctgcacatggagtagaagccagcaccgcattctccgctccgctgatatcatatgtttcagaatccgaagaatcgaacacgggaaatccagccactttgcttccttccatttttacttttccgaattttccaatggaatcaaatccgttgcacatattgataactgttggtgacaggatattccttcttacaatcgaaatctcctgaggagcttgaaaagatacccggctccctttcagccacacccctttcctggctaagattgtcacctccccactgctctcgatgttcgctcccaccctgtcatgaatttctgcttttaacgggactttctgtttcatatctacaaatcccaggctgtccggcaatagatacatacgtttatcctttgctgttgtaaaataccgctttgaaggatctcccatctcttcattgccggttccgttttttctgatacagctgctggccctggcatttccttctttgtcatcaaaggtgatcgtgatacgctctccgatttccggcatacaatacatcagattaccggtttccggcatccaaggataccaatacccttcaccggaaggcttctccccgtcaatatccagtttaacccgtacaccttcctgtttcgtttccagtaccgtgccgcccagggaaaccccggctatttggggattgtcgtatccggccgttccgaatgcttcgggagaacccgctatataatggtaaaccagcagaccattttcaagactgcacttttttgataaaaccaccttctctccgccatcaaacatagatatgtggtctcctgccttccagctttcatagctgcttatctcataacagataaactggggcttttcaaaatggtactgatcccggtcataggtatagtaagccttatcaaaccagattctctccggccgaattcctttccctcctgccgagtccccaaggggcaggccaaaatacagttccggttttaaggacccccctcccggaagcagggaagttcctaattgccctgcaatccgttttaaaaattcccagtccgtttctctgtattgataaatcggtttttcgatgttccggtcttcgatatgaaagattacatcagccttttctgtatcggataacacacttctcaccagttccttataagtcatatcaatcttttggaatgatctgcttttctcttctaagtccagcaattccgtgggcgatattgcttcaatccttgctttatactcattcccttcctgccatatctcaacattttttatgtaaccgcaaaatataggcggaacagcctcatttccattcacatcttccgctgaaaccgtcacactgcttcctgccagtttctgaaaaacaggagacgctcctgtttcagccggtacaaatcctgtaatcctggcgatggtatggcagttttttttaatatccaaatcaaattccttaatttcattgatatttaacccgctgctgattattagacttcctgatgtaactgcattcataaaataacacctcccccatttggttggattccctttataacatccaaaaaattcctgctatattaaatttacattatacgccaagaaacgccaaaaatattttacatgtattaattaaccatttatatgtaattttaggtaatactttgcttttttattgaggattgtgctcaatttcaatccgaaattcacgtcttctggtatctgttttttcgttccagccggtggtttcatcttccgattgatattctcctgcatccttttcgatacttacatacattatggggaaagactgaatatcctgtacattgctctgctgcttagttggagacttcttttgtaatagtactcctgtccctccccaacttcttgcctgtctctgtaaaagtcagatccttcttcagtccaccttcaatctccaaacggtctttataagataaaaacttagccatagtgtctccttttcccaccggctaagtttaatatatcacgaaaggcagggactgcgccctgcctttttgtaacacgaatttctctatgctattttcaaatatttgtacctaactttccctttcagacgggaaagttattttacaattgaggattgtcatttatgctcatttattgttattgttatttatgcagggaatctcctattggcatgatggaaaacaaaattgaggaggctataaaaacatcggacgttttattccttgagccaatattcagagccggaatccgtgcggcataaaaagccgtattcgattaacagccgcctgatgtaggggaaatcatgatacaattcctttaaagtgccgttaatctcactttcgctgtaacgggttcccggtaagaacttgtctgatacttcacgcaagaccactattttggccttttcccttgaagggaactgcttgattgccccacttttatcaaaatacctggacaggatcttcattctttcctccacagtaacatcataccggtcatccatcattgttgctgttttatgggcatcataaaactctgccttatcattttctgctttcatggctgcctcccttttattaaatatttccattgctgctaaaaataactttgattgtttttcctgttcatgaagcttataacggtaatttctcacagtcgaacaggaaatacctttttgcgcagctatttctttatcagataagccttctatcattaaagataatatggagtgctgtatctttgataagcctaaaaacgcagggttcatattcattaaataatccagcattgattcatgtttttcctcaatatgaacctttgccattttgtttgcatcataaaaatggccgctatgaggatatatctccccctttgtatactgctggctgcaaatcaaacaataaacggaatcatcgtcttcgtaatatccgttcattaattcatcaggagcagcctgccacagagattttctgtcaaacgaatttttcatgattttctccacttcatacattttaacattgcatttgtaatttgaaatttcgctcacaatagatattatatagtaatattttaaaaatgtctatgtataagtaaacatttttatattttgtttataatttatattaagattattatttgacgcagtcagggattatgtattttattatctttattccgcctcatccgggaggctgtcaccaactgcttataaggattatcatgaaattaaatgccctcaaacatgcaggtgacccgtagaacgtctgaaaaatatttgtctaagaaatacatacaaaaaatgctgcccaataaatgagcagcattccaaagttctatacattcattatcttatacaaccttatttttaatggtcccgatcccctcaattaagcattccacttcatctcctgccgccagaaacttcggcggttcaaatcccattccaacccccttgggtgtcccggtggaaatgatggctcctgccctgagggtcattcccttggacagctcgctgacaatatgatcgatgttaaatatcataagacgggtgttgctgtcctgtcttaactctccgtttaccttggactgaatgccaagctccggcggataggaaatggagtttgcagtcagaatacaggggcccatgggagtaaaaccgtccaggctctttccaaaataccactgtttatgggcattctgcacgttgcgtgcactgacatcattgataatggtgtagccgaaaatataatcctttacctgttccggggctacatcctttgcatcctttccaataatgactcccagctccgcttcataatccaggctgtccaccatatcgctgtggcttaagatctccccgtatgggttcaccgcctcattcactctcttggaaaaataaacggcattggggcgcgtccagtcaaagtcctcttttttaaagcgggcagactcctcggcatgttccatgtaattaagccccagacagataatgtcctgctccggtgtccggatgggcgccaaaagccttacctctttcatcatggcagctccgacgatgttgctcttgtaaggatccaggccggaagcatgttccagaagatcaagctcagactggctcagacccttgataacctccagcatctccttatactccataccaaatgccctgagaggaaagacccacatctcgtccttgctcactaccccgatatcttttctccggtcaacctcgtatgtaactaatttcataacatcctccttttacatgaaccatagctcttcctttgtggtggagattgcatccgcacctgcggaaaaagccgccataatatcctttttatctgatatcagtccgcctgcaataacaggaatatccgtataggcccgaatctctttcagcaccttgggcatgacaccgggcatgatctcaaccagatccggatgataggtatcaatctgctttttggtcgtactcatggcaagggaatcaatgataaaggttctctgtaccccaaccaatcccagctcaaccgcccgctttacaagaagaggctttgtgctgatgatcccatctgcaaaagtattctgcttaataaaatctacagcgatctccctggagcttaagccctgtgctaaatccgcatggacgatggcatgtttcccatgttcctttatctgctttacaatgctgctgatgttgcagatatttccatacagaatgaacaccacctggcattctgattcaaagcatctttttaacccattatcatccttaaccgctgcaatcaccggagatgcctccagtagttccattgccttcatcaatattcctccgcacccacaaaatatggatctcgttctactttatcaatccttttccccaccgtcaaggcaatttttgccctttctggcttttcctgagaaagtaaagcacattttaacgttcttttttccatacaagatagcaggagctgcggtctccggaaacggacgcctcgcccctgctatcgttatctacagttctttgctctgtgcccaccgcttacagacttccggaaagttgctgatgactccgtcgcagccccattcatagacctgctccagtgcggccatgtcattgaccgtccacacattcactgaaattccgtattccctgcagttgtccacagtctcttttgtcaatccctttacccccgggtggtagcattcaaaatgatacctgtcacagtagtatcctgcatttcccaggccctgatggtcaaggagggcgccgcacaggatttccggagccagtccctttaaccgggttatggaagaatggttaaaggaagaaaagataactttttcctcaagtccgtatttacgtacaagctccagggtcttctcttccaaccccttataataatatacgcctgtcttaagctcaatattagtaataagttcctgattttttgcccatttacaatattcttcaaaagtcggaacagattcaaatccgtggatccctccccagaccgcatccgcatcgaactttttcagctcctcataagtaatatccttcacaaatcctgttccgtccgtggtcctgtcaatggtttcatcgtggatcaccaccaccgttccatcctttgtaagctgtacatccagctcgatcccgtcacagcctgtctctgccgccttccgaaatgccagcatggtattttccggatacctgccgctgtaacctctgtgtgcgaataccttcatatcaacccttctttccttttatttccgcaggcaataagtccggcacaggaatgattgcatccctgcatttgacactctcttttaaatctctttccagtatagcatttcccggataatttttccacagattcccttgtttttatacaaaacagcctcgttaatctgcaggctgcccaaaaagatcaggctgcctgcagcaattacgaggctattttccgtgaatcattttaaatcttttcaacgttccttgtggcgacaatggaaacaccggttcctgcacagtccggaatgatcacatctccaatggttacaggtgcggaaacaaccgttttccggatttccttcatgcattcaaaaattttgccctttggaatatcctgctttgtctttacaggtaccatttccaggtcaccgcccagtattcggaccgaggaggtcactaccctggtggggcttaaaacctctttcctgccgtattcttccccacggctgcaggaattccctgtcacctcaacctggtctccctctatgcgcaccgtcaacggacagcctaaagggcagcggatacagatcagttctcttacctccatatcattccacctccgtacagacaacaattctcttaagttccggatattctttaaagctgtctttccttaatactacctgttccatttcaccaggagccagaatcttcttctttttatgggaaacccgtacatcatcataataaacgctgatgaagcgatccttgtatacatcggccacacggaaacggaccgtgatcttatccttcatattctccacgtccatcatctgaggcaccgtatagcggacaccgttctcagccgccagctccaccgtatgagccgcctctttttccatatcctcttttacataggctgcagcgctttctcctgccagggcggcttcctcggatacataatccaccagatcatggacatgaagtacatttccgcaggcaaagatgccttttgtgctggtctccagccggtcacccaccacaggacctgaagtcacctggttcatccgcactcccgctcccctggaaagctcattttccgggatcaggccaacggaaaggagaagggtgtcacagctgtaatattcctctgtgcctggaattggccttcggttttcatcaacctgggcaagggtaactcctgtcacccgctcctttccctcgatattcactaccgtatgactgagctttaatggaattccatagtcatccagacactggacaatgttcctttttaagccgccggaatagggcataagctctgccaccaccttcaccttggccccttccagggtcattcgccttgccataatgagcccaatgtctccggagcctaagatcaccacttcttttcccacgctgaagccttcgatattcatcagcctctgggcggttcctgcggaataaattcctgccggacgaaagcccggtatattaagggcacctctgggacgctccctgcaccccattgccaggataattgccctggcttttatggttgccaggccgtcttccctgttaattattgtcacttctttgtcctcgctgatagaaaggaccatggtatttaatttatatggaatgttttccccttccgccatctcaatataacgggccgcatattccggaccggttaattcttccttaaaggtatgaagaccaaagccgttatggatgcactggtttaaaatgccgccaagacaggattctctttccaggatcattatatccgtaatgcccgccttctttgccgccactgccgcagcaagaccggccggaccgcctccgattatcactatatcatgctctgtcatgtcgctgtcctccttatttatgaccggtcactaaattggagccgggcctgttcttacagatatcctccatggtcctgcctgtttccctagccaggatctccatggtccttggagcgcaaaagcccgcctggcaccttcccatgccggcgcgcacacggcgcttgatcccgtctaaggaaacggctcctaaggtccgtgtaatggagtccacgatctctccctcactgaccccttcgcagcggcagataatggttccgtactgggggttcttcttaatcagttcagcccgctcatcaaaagacagcctttgaggatccaggatcccctttcgtgtggccttaaagttctcttttttgtaggcgcccgcctttccggcaaccagctctgctatgtagaccccaatggccggggcgctggtaaggcccggtgattctattcctgccgcatcaaagaaaccggcagcatcggaaatctctcccaggataaagtcatccccatcctcatgggcccgaagccctgaaaaggaggtgatgatctggcggaagggtatgttcttcactccccaggcagctttttccatgatgtccgacagctcctttgctgtcgtcctcacgccttccttatcttccacatcacttgccgtaggcccggtcagtaagttgccgtggacggtaggggttaccagcacgccttttcccattttgcccggaagctggaagatagtatgggacacatgggtccctgcctccttatccagcaggcagtaatccccttttcttgcggtgatgcggatcttttcttcactcaccatgttatgaaatacatcggcatagactcctgcagcattgatcacataggaggcatggatgatcccatctccggtttttaagtcatagcccttttctgttttatgaatttctttcacctcagtattaaataaaaattctacgccgttgtcacaggcattttccgccagtgcaatggtcaggccaaaggggcagacgatcccgccggtaggcgcatatagggccgccacagcctgatccgtcacattaggctccattgccctcacctcatcgccggaaaggatggataagccggggacaccgttttctatccccttctcataaagctctttcagagcaggcatatcttcttccgaaaagcaaagcaccagagaaccgttccggatcaatgagaaatccagttcctctgaaagctctcccatcatgcggttgccttctacattgaacctggccttaaaagacccgggcaccgcatcgtgtcctgcatggacaatggcgctgttggactttgatgtgccggaacagacgtcctcctccttctcaatgacgcagatgccaagatcatagcgggccagttctcttgcaattgcacagccgattacgccgccgccgatgatcgctgcatcgtaactcatttccttcatgtttttctcctccatatccataatggtcacccatatttgtggaaattgtttttataatataaaaaagagtaaggaaaatacacggatccctccgtattattcccttactctttcatctcaaaggtttttatattctgttgacttaatgctagcacaacccttgcgggattgtcaagatttttctgccatgagcatcctattcgctcaccgccatgaccgtattctcctccgccagcttggataacaaggccccttgtcaaagcccggcggatagatgacttcaaattccagcttgatctcatcctttttattcttgttgatcttcacggaagagatttctaccttttccttttctaaaaactcctccatgcttttcactgctccggacttctgcgctatggtcatacgcaggcagccgcaggaggccacctgggcaaaatagctgatcctgtgggtcagcatctgcatgacaatgatgagaaccgctgacaatatgcccacaatgtactggcccgccccaagagccagccctactccggcagtagcccatattccggctgccgttgtcagaccgtttaccagattgttccggacaaaaataacacctgcccctaaaaatcccactccgctgactacctgagctgcgatcctggccccgtcgctggtgggaatgtccggaaatccatacttggaaaccaccatcataagggatgagccgatcgccacaatggcatgggtccggattccggctgatttattccggttttttctctcactgccgatcaaaaaccccaaaaggccggcagtaatgatccgcagcatatattccagctgaatcatcacatatgataaggtaaatcccccaaacaatatatatgtaccttccaaatcctacccctccacgttctacgactcgtcctcagaccataagagcgcacattttacagccctcttccagccctttaccagctttttccggtattccagctccatctggctgtcaaacgccctggaagccttccagtttttcttgatctcttcccggtccttccagtatcctaccgcaagacctgccagatacgcagcaccaagggcagtggtctcaatgcattccggcctgacgatccgtgcatccagcacatctgactggaactgaagcaggaagttgttggcgcacgctcctccatccaccctcagctcctttaaatgtattccggaatcctgttccattgcctcaatcagatcatacacctggtaagccatggattccaccgtagcccggataaactgctctttgctggttccccttgtcacccctacaatggttccccttgcatactgatcccaataaggagctcccagccctgcaaaagcaggaaccacatagactcctcccgtatcttccactgcattgcagtattcctctgtctggggcgcggatcggaccatgcgcatctcatccctgagccactgtacggcagcccctgccacaaagacgcttccttccagggcgtactgaatcttatcctgttcactggctgctatggtggtcaaaagcccgtgctctgactttaccgccttttctcctgtattcatgaggagaaagcagccggttccataagtatttttcatctctcccgcctcaaagcagcattggccgaacaatgccgcctgctggtctcctgccgctcctgcaatgggaatcttccctcccatcacatccgaagaagtgtagccatagacacagcttgaaggcttaacatcaggcagcatggtgcggggaatgcggaaatattccagtatttcttcatcccagcactttttatggatgtcaaaaagcatggtacgtgaggcattggtataatcggtcacatgaatgcagcccttggtcaggttccagatcagccaggtgtccacggttccaaacagcaattctccccggtccgcccgctctcttgcaccctctgcattgtccaggatccattcgatcttgcttcctgaaaaataagcgtcagggatgagcccggtcctttcaatgataagctcctccaggccgtcagatttaagcttctcgatcctgtctgccgtcctgcggcactgccatacaatggcatggtaaaccggctcccctgtctccttatcccagaccaccgtggtttccctttggttggtgatcccgattgcagcaatgtcgctgtaatgggcccctatctttcccatggcctccatggtcacggaaagctgtgaggaccatatctccattggatcatgctccacccaccccggctgcggaaaaatctgagtaaactccttttgtgctgcactgcagatgttcccctgctcatcgaacaggatgcatctggaacttgtcgtgccctgatctaaggcaatgacatatcttcccataattcccttcccttccagtaattgcctccggattttatcccttgttaaatttttctcaaggaataaagaaagagccttggaaatgaacggttacccgcactcatcacctggctctgtcatctcttaggctatgtatttatatttacttaatactaccatgtaccaaaaactatgtcaagatttaagggcattattttctcagtgaaggctctctcttacggtcttaaatgcctggatcacaagcgtgggtataaatgcaaaaatgaagatggtaataaactgccttgcagtcaaatctgccacataaaaaaaggtatgaagccctggtatgaacagcacggccgccaaaagaacagcccctgcctcaaaggccataatgctccacaaattgcttttaaagccgatcttcaaaatggaatggccgcttctgcagttaaagccgtgaaacagccttgcaagggtcagggtggaaaatgccatggtgctggctgctgcctcacttcctgtcaccagtcccgtgtggtaggaggtcatggtacaggccgcaataagggcccctgaagcaggatctgaaagacaaaacgctttgttaagattccttctttagggtttctgggcttttgggccaaaagatctgcttccgccttttccatgccaatggcaatagctgggagagaatctgtcaaaaggttgataaacagtaggtgcaccggcgcaaagggggtgggaagtgccaggaaggatgtatataacacacataagatccctgccatattccctgataaaagaaatttaatggcattcctgatgttccggtaaacattgcggccgtttgcaaccgccttgataatggttgcaaagttatcatcagtaaggatcatggcagatgcatcctttgacacttctgtccccatttttcccatagccactccgatgtccgcctgctttaaggcgggagcatcattgaccccgtctcctgtcatggctacgatatggccctttttctgccaggaacggacgatccgtatcttgtgttcaggtgaaacccgggcgtaaacgctgatgtgttccagcctgcggtttaattcctcttccggcatttcatcaagctccggtccgctgaccgccagatcatcttcccccagaatgccgattttctccgcaatggccgctgcggtaatcttatgatctccagttatcatcaccggacggatgcctgctctcctggcattcagcactgcattcctggtttccggacggggcgggtccatcattgcggccattcccagaaaggtatagccggactccgacttttccgtcagcctttcatcctcttgcatctccctgcaggcaaaggtcaggactcttagcccctgcttggaaaactccatgttctgttctgtcaggttctgccggtccccatcccttatgggacggaccccttcccctgtccagatatggctgaccctgggaagcagcacatccaccgcaccctttgtgaacaggactctctttccctcgatcctgtgcatggtgctcataagctttctctgggaatcaaaagggagctcacctgccctggggtaataggacttcatggcttcctcttccattcctgcccgctccgccatctgcaccagcgcagcctccgtgggatctccgatcagctttccttctatataagcggaatcattgtttaaaacagcatcatacagcagatatttatgtacaggaacttccttgtttaaaagctccggaggataaaggcggctgtttacgtagacctgctgcacggtcatgcggttctgtgtcaatgttcccgtcttatcggaacagatgactgaaacgcagccaagactttccacggcctttaaatcctttataattgcattttccccggccattttctgagtgcccatggcctgcacaatggtgacaatggagcttagcgcctccgggatcgccgcaactgccagggccacggcaaacatcagggaatccagaaccggcatcctccgataaatgctgagtccaaaaaccaccgcacagacaaacaggattcctgccgccagcctgcttccgaactggtccaggctcacctggagaggggtctttttttctccggtgtcattcatgagggaagcgatcctgccgatttccgtatccattcctgtccctgtaaccaatgcctttgccctgcctgaggccaccagggagccggaaaataccatgtttgcctgctctgccaaaggcacctttttttccatgatccttcccgtccgtttctccacattgacggattctccggtgagagagctttcattgaccaaaagggagtaattttctaaaatccggccgtctgccgccaccatatcccctgcttccaaaagcaggatatccccggcacgatctcagaagacaaaatctcctgcttcctgccatctcttatgacctttgcagccggcgatgacagagccataaggctatccagagacttttccgccttctggtgctccaccgtccccagcaccgcattcagcagaagtaccgcaaagatcactcccgtgctttccacatcaccggatatcatggagatcactgctgctataatcaggatgatgaccaataagtctttaaactggtccaaaaatacctggaaagcgttcttgcgttccgccttcttcagtgtattggaaccatatatctgcctgcgcctaaggacttcacgggaatccagcccgttcctgcctgcgccaagctctgcaaggacttcatcctctgataaacgaaaccattcttccattatgacgctccttcccgtttctcatattatgaaaacaaaaagatgttttcataatcggatggacggcagtaaaagcactgccttttaacagaaatctgaaaggcgatttctgataacctatactatggtatgagacaggaagggaattttattctaagaccgaaggataatccgggaggcgattttataaccggccgaaacgttttctcttgcagggagctgttttttttattataattttagcaatagaaagaaaaaaactatgaaccccataaaaccattctcagaaaggacatgataaccatggaaaaaataaccagctttaccatcaaccacttaaaacttcttccaggcatctatgtctcccgcaaggaccaggccggggactctgtcatcaccactttcgatatccgcatgacccgccccaactttgagcctgtcatgaatacagccgaaattcataccattgagcatctgggggccaccttcctgcgcaaccacgaaacctttgcttcccgggtcctttactttggccccatgggctgccgcaccggcttttaccttctgctgtccggggattacaagtccagagacattgttccgctgattacagaaatgtacgaattcatccgggactttgaagaggaagttccaggcgcttctgccagggactgcgggaattaccttgacatgaatttagggatggcacgatattgggctggaaaattccttaattccgtgctgtatgggatcgatgacgaccagctgctttatcctcagaactgacggcttctttccccatacaatccccgcttaaggaaaaaatgaggaaaccgtttatccgcaaaaagccgaagaagaggcaatcaaatgccttctcctccggcttttatcattcttcccgcatttccgttacttcttccgccatccggtatcccacacccatttccgtaaggatgtactgaggctctccgggatttgtctctatctttctccgtatgttagccatgttgacacgaagggtatggctttcatccgtatagactccccatatttcccgtatgataaaatcgtgggtgagaaccttgcccgcattttgggacagtaaaaccaacagcttatattctatgggcgttaaatggattttttctccggctttgtataccgcccgtttgctgtaatcgatctccagatttccgatgatgaccttttcttctcctgaagcttccgctccggccgtctgggggctgtgccgcattgctgtccttatcctggccaggagttcccaggttccaaatggcttcacaatataatcatcagcgccaaaatcaagggcagccaccttttcccgctcatggccccgggcagagacaacgatcacaggggttttagaccattggcgtatggttttcagtatctctgttccgtcaatgtccggcaggcctaagtccagaaggatgatatcaggaacatgggaggtgaacagggaaagcccttccctccctgttttggctttcaccacctgataaccgtttgaggtaagaatggcagagataaaattgcagatggcctcctcatcctcaatgatcaataccattggtttcatatccatattcattcacttcctttcaaaggcagggtaaagcggaatattgttcctccgtcttttctgttttccgcttctaagcttccctgatgggcacttactatggtcttgcagatggacaggccgatccccattcctctggaggaatcggcacttttgctttcactgggcctatagcctgtaaataaatggggaagatcttcattgggaatccccctccccctgtccagcacctggaatctggcccatgctccttctttctccaggcaaacctcaacgggagaatcccccggagagtattttatggcattttcaagaaggtttatgagcacctgcacgatcagggtcccatccattggtacctctaagaattcctcagggacatggacaaggatccgggcttgaggaaatctccttttgacccggctgacagcttctccgataacctcctcggctgcctcctgacttttggtaagattggaagcgtcctcgttgatccgtgtcacggaaaggagattttctaccatgcgtatgagccactgggattcctcctgtatgttggccaccagactgtcccgggtattctcgtcaagcgttttcccgttttcacggatggcagagctggctcccaggatacctgcaaggggagtgcgaaggtcatgggagatggcccgcaaaagggtgctccgcatcttctccttttccgattccaccatgatgtttcgctgttcatcagaaagctgctgccgctctaaggccattgccacctgggaagcgatcatgcgcaaaaacaggcgggtgctgtgatcaagggttccatttttgcaggaaactccccagacggcaagaacctttccctgtgagatcaccggcatataaaacgccgccgctcccataagggtatcagttcccgctcctgcccgcttctggtttaagaacacccagtgggcgactgctttttcatcggcagagtttaagacagaggcacccaggtcatccgatgcctgggccacttccccgtcctctccctgttcagggtcaacggtgaaaaagattatggaacgtccgaacagcttgacaacgtaatcatttgtaagtgccacgatccggtcaaggcccctggtggcaagaagccttttgttgatctcatacagaatttccgtgcggtgttccctccttacggcaagccgggcttctgccttaatgcgcacggtaagggcactggtgatcagggccactaaaagcatgatcgcaaaggtgaggggataaccggtctggatggcattaaaggtgaaatagggttccgtaaaaaagaagttaaaggtcagcacgctgattactgaagcaatgattccgtaccaatacccttctgtcatacgggaaaccagcagaacggaaaaaatataaaccataataatattctggttcataatgtcaagcctgcggattccataagacagcagagtggcagccaccagaatggagaaggtttttatggcatccccccaggaaaaatggaacgtttcaaaccttactccttttttgggctttttatagcttcgcctgcctgtatttcccggtataatatgaatctcaatgtttggcaaaagagagatgagcttgtcttcaaaatccatatcaaacaggtttttaagtgtctttttatttctgctttttcccaccacaatatttgtgattccggaaagctttgcatattccgatacggtaacggcaatatcatggccggtaaggttgacggtctctgccccagcttttccgccaggtctaagttggaccgaagggttttctgctgttccgcagtgagatcctcattccctatatcctccacatacaacgcggtccagcttgcatggaaggcttccgccgcccgggctgtccaccggatgcattttgccgatgaaggagaagcaccgatgcagacaagcagcttggtatttgccattttatcagacaggctccgctcattctgattttccaggctgatcttgtccgcggcacagcggagggcaatttcccgcaaaagccgtagattttcctgggtaaaaaagttctggacggcagcctccgcccgttcaggacggtatattttcccctcttccagacggcgcagcagttcgtccggcgcaagatccaccagctcaatcttttcagcacggtcaaaaatgtaatccggcacggtttcccggaccctgacctttgtaatgttttcaatcatatcattgaggctttccatatgctggacattcaccgttgtataaacatcgattcctgctcccaacagctcttcaatgtcctgataacgctttttattccggccgccttctgcattggtgtgagccagttcatccacaaggatcagctccggctttcgctccagagctttatccaggtcaaactcctttagctccatggtccggtatgatactgttttcgggggaaggaccggaagaccatgcagcttctgcatggtctcaggacgggtatggggttcaatataccccaccagaacgtcgatcccgcttgttaaccggtcatgggcatcgtcaagcattgcataagtctttcccactccggcagcatacccaaaaaatatctttaatcttcccggcctttgatcccgacgcaccaaaatatcttctaaaatcgcgtcagggtcaggtctgtgatccaatggttccattcatccaccacctttatattcccatatcataccactttttccggtttcagcaaaccatcaagcgctaaattgacctgtaagacattgaccgccggctggcctatgaatcccaggaaacggccttttgtataagtcctgataatgcttctcacctgatcttctgttatattcctggcagccgcgatccttgctacctggtattccgccgcatcaggggaaatatgagggtcaacgccgctgcctgaggctgtaaccaagtccatggggatatccgccttattatccgggtcaaaggaatgccaccggctgatacgctccgaaacaagctcctgctgttcttttcccacaggggagaggtttgacacgcctgacggccttcctatcaggtattgaggttttgtaaattcctgagcgatccactccgatccatactctttttgagacccgtctttttgggtgacaacgatcatgctgccgttggcctgatccggaaataacagctgggcagctcccgtaacggctgccgtataaacgatgccgcacaatatggtcatgatgccaaagcatacggccgcggctctgaataatttcatgattttcatagtctccatctcccttatgcaagaccgcacgcggtcagaatcatgtcaatcagtttgattgcaagaaacggtgcgcagatcccgcccaggccatagaccagcaggttccgtttcagaagcttttcagcaggcagttcccggtactttacccccttaagagccagaggaatcagggcaataatgatcagcccgttgtaaatgatcgcggaaagcatggcgcttttggcgctggtcagccccataaaattcagggccgaaagctgggggtaaataccaaagaacagcaccggaataatggcaaaatactttgccacatcatttgccacgctaaaggtggtcaaagaacctcttgtcattaaaagctgtttgccgatccggacaatatcaatgagcttggttgggctggaatctagatccaccatgtttcccgcctcctttgcggcctgggtccctgtgttcatggccaccgctacatctgcctgggccagggcaggagcatcgtttgtaccgtcacctgtcatggccaccagatggccttttgcctgataatcgcggataagggccagctttgcttccggcgttgcctctgccagaaaatcgtcaactcccgcttccgcagcgatagccgccgcagtcatgggattgtcgccggtgatcataacggttttgatgcccattttccgcagatcctcaaagcgttcctttacgccgttttttacgatgtcctttaaataaaccactcccatcacctgatggttttttgccaccacaagaggggtgcctcctgcctcagcaacatgctttacaagcttctcacattcctcagggtatctgccgcccttttccagcacatatgctttgatggtatcggcggcgccctttcttatctcattgccctggtagtcaatgccgctcatcctggtctttgccgtaaacgccacaaaggccgcgcccagggctgaaagctctctgccccgtattccaaaccgttcctttgccagtaccacaatgcttctgccttctgccgtctggtccgcaagggatgaaagctgagccgcatcagcaagctcccgctccgtaacggttccgaccgggagaaattcgctggcctgacggtttcccagggtaatggtcccggtcttgtcaagcagcagcacatccacatctccggcggcttcaatggcacgcccgctcattgccagaacattggcctgatttaagcggctcatgccggcaattccgatggaggaaagaagagcacctatggtggtaggagcaaggcataccaaaagtgctatgacattggtgatggaaatggcggaaccgccccctgcctgaaggctcgcaaagccggtaaagggccgaagagctgccgttaccaccagaaagataatggtaagggttatgagcaagatctgcagagccacttcattgggcgttttctttctggatgcgccctctaccatggaaatcattttatccaggaagctttctcctgcctctgccgtcacctcaatgaccagccagtcggacaccagggtggttccccctgtgaccgcgctcctgtccccgcctgattcccggatgaccggcgccgattctccggtaatggcactttcgtccacagaggcagccccatcgatcacttctccatccattgggatctgctcaccggcctttacatatacgacatcgcccttctttaatgtgttggaaaggacttccgtataatcgtccgtattggcgggagagctcagctttttcgcttttacatcctttttagcgctgcgaaggctgtctgcctgggcccgcccccgcccttctgcaatggcctctgcaaagttggcaaacaacacggtaaaccataaaatcaacgatatggttaaggtataaccggaattttcatccttaagccctgcaaaggaaagaaaatataaaaccccggtcaggaccccgcctatataaactaccagcatgacaggatttttcacctgcacacggggagacagctttacaaaggactgtttcagcgcatcataaaagatgcttttatcaatactctttttttccatttcaatcaccttctatcactggattgttaaaaaatcagcaatcgggccaagggccagggccggcaaaaagcttaaggcgcctatgatgaggatcactccgatcaacagcccgacaaatacggtattgctggtggacagcgtcccttcactgacggcaactgcctttttctgcgccatattccctgcaaggaaaataactgccgtcatgggaataaagcggaccatcagcataatgaccccgcctgatacattggtaaatacggtattcccctgaaaacctccaaaggagctgccgttgttatttgccatggatgaaaaggcatataaaatttccgaaaatccatgggctcctgaattggtcagccatgaccgggcctcaggcgctaataccgcggcagaagttcccaaaagggtcagaagcggaggaaccaggacgatcaggcacaccattttcatatcaaaggggtctacctttttccccagatactccggcgtcctgccgaccatcagacccgcaataaatacggtgaggagtacaaaagcgagcatcccgtaaagtccgcttcccacgccgccgaatacgatttcacccagctgcatgaggaacatggaaaccattcctccaaggggagtgaggctgtcatgcatggcgtttacggaaccgtttgatgctgcggtggtaatgactgcccataaggaggaagcgcctacgccgtgtatcacttccttgccttccatgctgccggaagctgccacctgtttaaatacaggacctgtaaactgctcgctggcagttgctgctgccagggcagccgtgaggaaaatcatcatggtgatataaaccgaccgcccctgcctgccgtcttttaccgcctttccaaagcttacgcaaagggctgcaggaatcagcaggatggataaggactgtatcatgttcgaaaaagccgtgggattctcaaggggaaatgcagagttcgccccaaagaatccgcccccgtttgtcccaagctgcttgatggcgatctggcttgccgcagggcctaagggaatcgtctgcaaagccccgctttccagcatggcaacatctttgtattgaccaaaggtctgcaccacgccctgggagacaaggagcagggctgccacaaaggaaagagggaggaggatgtagagggtggctctcaccagatccgcccaaaagttgccgatggtctttttctgtttcagggcaaatcccctgatcaaagcaaaaaggaccgcgattcccgttgccgctgaaacgaagttctggacggcaaggccggaaaactgggtaaagtaggacagggtggactcaccggagtatgcctgccagttggtattggtaacaaagcttgcagccgtgttaaaggccaggtgccagctggttcctctcagcccttccggattaaagggcagtgtcccctggagcatgagtaagaggaaaagaaaaataaaaccggccccgctgaataaaaagacagaaagcgtatacttccacgcattcatttcttcctcaggggcagtgcccataagcttatagatctcccgttccacaggaccaatgacaggggtaagaaacactttttgccctgtcatcaccctgtatatatagattcccaggggaatggacaatccaattaaaactgcaatataaaacagatcctgcatcaccatatagttcataaacggtcacctcgaaacagtacgtaaaataaataaattaacagtgaaacaccgataatgcttaccagcgttaaaataactcccatgatttcatctcctgatcattttatttttctcctgctgccggcttcatttccggagcattacagcaggatcccttgtgaccacaatcatatcaaagaaaaaatcaagacagtgttaaaatggaaaggagatgtgtcaagaagttgtcaagaaccctccggcttgatcctcccctctccaataccctggttttgcacaactggagaatgaacggaagaataaatggtttaaatttacaataaattgatattgacaatattgtgtatcacacaatataataaggctgaggtgatattatgacggaaaatgaacagtttcagagctatattacagagctgcgccgcggcagcttaacactggcggtgttgggatgtcttcatcaatcacattatggctacgccctgcttcaggagatgcagggaaagcatatagacattgaagccaacacgttgtatccgctattgcgccggctggaaagccagggcctgcttgtcagcgactgggacaccagcgaaagcagacccagaaagtactacattatcaatgaaaaagggaaaacgatatataaggatttgatttcggaatggagaagaatgcaggaaagttttgaatccattataggaaaggaggagcacaatgagtgattacattgaacgctatgtgtatgatgtgacccgacggctgcctgaaaaagaacgggaggaaataagcaaagagctgacggccaatatttacgatatgcttccggaggatgcaaatgaaaacgagataaagtcggttttatataagctgggagcccccgcattcctggcggggaaataccggaaaaaccccaggtatttaatatctcccggcatttatgatgaatatatcagcgtattaaaatgggttttacccctggccggtgtagtgggtatggtgatcggcataatcgtgggttccaccggttccataagagatggaatgataaatataagcaaggcgctttcaacggggatctcagcaggtctgtctgcagctttccaggctcttgcatggacaacaataggctttgtgattgccgaaagaaccgggaataaaaattctgaaagcacaaactggaaggtggaggatttaccggaagtgcttccccccagcaaataccccatctctttgtccgacagtattgcagagctggtacttgtcgttgtgtttgcagccgcagcaatcctcatatgcagcgggacagtgcccattgcatttatgatccagcacggcagcacacaggtacgtaccttattcagtcccggatttttggaaagctccattcccccgatcatagttatggccctgtttggagccggggaatgcattatcaagataaaagaccgccgttggacggttcctgtatgctgtacagtcattctgagcaatatagtaagtgtatctgccctgatttatcttcttgcccgcccggacattttaagcgaagagttcaaagggtttatgaaggcaaacctctgggtgtcttccggtccgttcctatggggaataaatcctgctatgatacttctcttaattgctgtcctgtgctcatttgcagagtgcggcaatgccatttataaaacgattaaaagcaaaaggattgaaacaccataaaactaaccgaatcagaaggatcgattagatatacaatctgatgttctcaacaaatgagcaaaaatagcatcctactctttaaaaagcagaaggatgctattttttatggtctatgtatgacatactgtgacatcatgagtatgaaagccaatctcctggcaaaaaatgcagcgccatcatcgatgataaaaatctaaaatacgccttgccaggctttctgaatccagttcataagctcttagcagttccattgcagagcctgatcttccgtagacatcattgacacctatttttaaaacagggacgggataattttcagacagagcatcacacactgcgcttcccaatccgccgataatggaatgttcctccaccaccactattttccccgtcttttttgccgactggatcaccagatccttatccaaaggcttaatggtgtggatatttatgatttgtgcctgaagccctttttccgccaatattttctccgcctccagcgcttcatttaccagaattccatttgcaataacagtaatatccgtcccctcctttaaaattacccctttcccaatttcaaaatgacagtcctccctctgattaatgaaaggaacagggactcttccaaatcttaaataaacaggccctttccgttcatatgctgcttttaccgccgcttttgtttccacatcatcagaaggacataaaacaaccattccaggtatagctctcatcagtgcaaaatcctcattgcactgatgagtggccccatcctctccaacggatatcccgccgtgagtggctcctatttttacattcagtccagggtatccaatggaattgcgtatctgctcaaaagcacggcctgccgcaaacatggcaaaggaactggcaaagggaattttaccggttaaggacaatcctgccgcaactcccatcatattgcactccgcaatcccgcagtcaatatgcctgtctggaaaagcctttttaaaaagagcggtctttgtggccgaagccagatctgcgtccaatacatataaatcttcatggatacggcctaaatctgccagcgcttctccatagctgtccctggccgctttttttatgatctctgacataaaagtttcctttccctttccagttctcccatggcaagctgatactgctcctcattcagtgcaccgctgtgccatgacagattattttccataaatgagatccctttcccttttactgtttttgcaataatcaccgttggttttccttttgtctccctggccgtcaagagagccctttccagctcctcaaagctatggccatcaacagtgatggcatgaaagccaaaggcctcaaacttcttatcaataggataaggagagcagatttcttcaacggtaccgtcaatctgaagattgttattatccacgatcactgtcagattgtctaatttcctgtgggctgcaaacatggcagcttcccatacctgcccttcctgtatttccccgtctcctgccaaagcataaacacggtagtctttcgaagaaagctttcctgacaatgccattcccgctgcaactgagactccctgtcccagggagccgctggacatatccacaccaggtgttttcttcatatccggatgcccctgcagcctggaacctattttccggaaagtcgacagttcggccgcagggaaaaagccccgccgggccaaagccgcataatatcccggtgttacatgaccctttgataagacaaaccggtcacggtcttcttttcccggatcattttcatcaatattcaattctttaaaaaataagcaggtcagtatttctgctgcggataaagacccacccggatgcccgcagccagcatgatatacggcatctatgattcctttgcgtatatcattggctgttaatttcagctcctcatattccatcccgatccctctttctaaacgatctgacaatacgctctgtctattggtgaaagaaatgctgcaatgcctgaacagatcctcaggcattacagcctaccttatgtatcactatttcggatctttcttgtcaggctttacaactgagacagcaatcatgactgccagcactccaaatacgaatatggtagctgccataggccctaattgtcctgcctttcccattaagaatccggaagctataaaatccagatcagagaaggttgttccctggtaacccagatcgcccaggagaggcattaataaaagcggtgcaaaggtcagcatcaaaccgtttataaaggaaccgaatacagctccttttacccctccgttggcattgccgaagactcccgccgtggcgccgcagaagaaatgaggcacaactcccggcaatatgatgattccgccggtgagaaccagaattgccatacccacgatcccgcctgcaaaactggaaaagaaaccaatcaacacggcatttggcgcaaaggtataaacgatcgggcagtccagtgccggctttgcattgggaatcagtttttctgagatgcctttaaaggccggcacgatttctgcaaggatcaggcggactccctgtaatataatcaccacacctgccgcaaactgaattccctttgtaatggaaaacatcatataattctttccgtctgaccagttttcctttatgtagtccggtccgcaaaagagtgcaagaatcacatagaaaagaaccattgtcagggaaatggaaacggaactgtcccttaaaaatgcaagggatttggggaattcaatctcctctgttgactttgaatttttccccactaatttaccgatcattgcagaagaccaatatccgattgtgctgaaatggccaaaggccacatcatcggttttggttatctttttcatggtcggctgcgccagggcagggaacaacaccatcacaattccaagggcaaccgcgcccaccactacggtcatagccgtagacatgccgatggtaattaagataacgccgatcatacaagccatgtaaagggtatggtgccctgtaaggaatacatatttaaacctggtaatacgggcaatgataatgttggcaaacattccgaaaaacataatcagggcagtgacctggccgtactcctttaacgccaccgctataatggcctcgttattgggcacaacccctgccgtatgaaatgcctcctgaaacattcctccaaagggagccaaggatgcgacgatcacatctgctcccgccgataacacgataaaaccgagaaatgattttatggttcccctgatggtatctgccgccggtttcttttgcagcagcaaaccaatgaatgcaattaatgccactaacactgcaggggttgaaagaatttcctgtatgatttttaaaacagccatggttttctcctctctatgcgcaatcagattacattccgtttctttaacgcctcttccaatttttccttcagttcttttttatccagcaggttttccagctccaccactccttttaaatgggtcatccccattgcaatatctcttccggcaataaagatgtccgctgctcccggcgcggcacctcccaaatcactgtgatccacctcgatccctgctgccccgatctcctttaaaacatttttaatattcatctccaccataaagctgcttccaagtcctgaaccgcacaccgccaatatcttcatatgacttcctcctgacttttttattcttcttccatatcgatcagttccatcacatcctctacggaactgcaggctaataattgttccctggtatcttcattggtcaaaatattagataattgggcaagggctcttaaatgtgtgtgattatcaatggccgccagggtaatgaagaccttcaccggcttctggggattatccagcacgcagacctctttttccagctttaaaaaactcattcccagcttatggacccctgcctgattctgagcatgagggatcgctacatagggacatattacgatatagggaccaaagcccttcacattgccgatcattgcattgatgtaatcttttgttatggaaccattctccaataaaggctttgcccccagccagattgcttcctcccaactgtttacactggaagcaaattgtatggtttccttcgtaagaaggtcttttatcacaggtaatccttcctttccgactttttctttttatattgtttttgcagaaggtcctttaagtcaccgcttaaccccttccggtcatggatcaccgcgtatttttccacaatttccaggattgaatgtacggtcataccggcctctgacttgattccaaatacagaagaatataccgcttcactgataataaaccgttcttctaccgttaagatgggggaggatacgaacatatgcttctcttccggcacatcgattccttccgtagtggaaaaaaccatatcataggtttccgggggaacctctttaaactcttctgcattacaagtgtccgcgaaatgtatttcaggaaatatctttattaactggtttttcatcatcacagagcttgcaagtccgttctggcatacgataatggctctttttctgatcttatcctgatccggaagatccattaccgtcatgaaatgcaaagcaatataggcaatctcatcatcaggaatgaagcagtctaagtagtctccaaagggttctagcacgagcctgcatatgtcaaacacctctccaaactcttttttaacctgcttcaatgccggattcaccaccggtatcccgtactttaaccgaaaataggccaaacgcagatgcatcagcatattttccgatatgcccgccttcttttgtaccacagttccggtaatgacttcaaaccggttaatcagactttggcacagctcctgcaaaaacacactctcctggttgtaaaggtggaaatacattttatcccctaaaaccgtgcttaacaaaaggacaaataaatagtcagcctcttcttcgggcagatgaaaggtcagtgattcataaaaagctgttacagctgcataaagggggagttgattccacgtggtttcatgtatatggacaggcaagtatgtaatggattggcagtgataagggagcaagctgataaaatatatcacctggatcagatattccttcatgatcggcagattaaattccttaatcaacgactctgccttagcttttgtctcctcaaataccacatcataggaaggatccgaaacagccagtgaaattaactttttacataaaaaattgtccttcaggttaataattgcaagcaataccagagaacggatcttaaccggctccccttcaaagtaataacccgattttcttgagtatttcaattccaccttatactgcctgccgatctttgcaatctttcttaaatcatttaaaacggtattcttgcttgactgcagattaataataaaatgattcagccccaggggttcccttgtgcaaaagatctggatacagatgatccatattttgttttccccattaacagcaaatttctgccggggcaggtttaatccggatattttgttgatggtttccttattaatcagaaacttgccttttgacagtctgatcaattcaatctcattttctttcagcagttcattgattttgcttacatcatattcaatctgcctttttgaacaccccagcagatccatggccttgcttacggaaaaattcctgtcattcagcaaatactgcagcaaattgaacgcgcgcttttcaataatttgcattgtcccacctcttttttatgcaatatatcactgattccctgtaattattataattaatcaggcactatttttccattttaattggtacctaaatttgttatttaaaataaaacaaaaatgtgctcatatacaatatgaaaattaataaatacaaccaattgctgtccaaatattttgtatcattgattcaaagttgataaaaccataaaaaataagggcaatccggattgattgccctcaaacacatcataaccatatataattttcttttaacaccggtcattttttccccatcagcaccacaatggatctgggcggaaccagaaaactcttgccttcagccacaggctcctttccttccgggtacattccgtttgcatctgcccgatccgtatgaaaggctacatgccaccgctcctttttaggcaggttgggaagatcaaattcgtggggttcccagtgcatgttataagccacataaaagttgttgtcataggttccatccggtctttttccatattccccgcagtaaaagactccaagctggcgccggtaattatcaaattccggacaccatgcctttactccgtgataggaaacatcaggaagaccgcaggccagataatccatgatccttggctccttaggcatatggaacaccggatgagcctttcggaaagcgataacagcctttacaaactccagaatatcctggttggtcctgaccagattccaattaagccacgacacttcgttatcctggcaataggcattattattacctgactgggaattgccgaattcgtctcccgccataataagaggagttccctggcttaaaagtaaaagaaggaatgcgttgcgaagctgctttttccgaagctccatcaccttcttccgcttggtaggtccttccaccccgcagttccaggaataattgtagggactgccatcctgattgttttctccgtttttctcattatgcctggtatcataagataccatatccatcatggaaaagccgttggtattggccatataattgatggtcccgtattccggcggatttctcctggtccggagggcaaggtttttcatctgttcctcatccccctttaatacccggcgcatgtctatgagaaaaccgtcgttatattctcctaaatgtttgatttctccctttgagaccggctcccaggagaccgcaaacagtttgatcctgcttaaataaggatctcttccaaggaggtccaggggcagggtccccaccagatggatcccatccacatggaactcatcagcccagaaacggaccgcatcaagaacaaaagagggcggttccttacctgtaaaaaaaagctccacaatcaattccagaccttctctatggagggccttcacaaggcttttaaactccagggcagggtcctttccccatgcataggaagccttgggagcaaaataatagcctgaggtatatccccaataatttaattttcctgtgggtttatccacaccggaggggtctccatgcacatattcgggcataatgacctcggaaaattcattcaccggcatcagttcaacagctgtcacacctaattcttttaaataaggaatcttctctcctatggcatcaaaggttcctctatgctttaccttagaagaggcatgctttgtaaacccacggttatgaagcctgtatatgatggtttcctcatatggaatctgagggagcttatccccttcccagtcaaaatcagcaaactccatgggtgaccttaaaagggcagaagcatgttcaagatctccccaggtctcccgtccggtaaagtgtttcccgtaaggatctgaaaacagttttccatcgatttcaaagcagtattccagatcattaaaatcctctcccagaatggtcatattccatacatcgccctttctgcactctgacggaaaagacagggtctggaccggttcttttgctccggtcttataaatatggaccctgcattccttcccttccgcagccacacacaggcggatccctccggatacttttgtaagccccaaaggatatgcctccatctcatgctttgcaatcttgtactgttccatatcacttatctcctccgtctcttggtctgattccgggacagttcctgcttgtttttactgattttcaatctgctctgccagatcgtttaaatacatccaccgctccatcttctcttccagcagtccttcctgctctgtcttttcttccatcagggcattcagcctgccatagtcgctggctgcttctcccatctgcttttccaggttctcaattttagcttccaaagccgcaatatcctcttcaatggtatcccattcccgttgttctttaaaggagaatttaagcttcctctccccttttggcttttccttattctttttctccggagcttccgcattttttgcaggaccctcatcctggcctggaaggccctgaggatatttctcctggaaagccacctgataatcggtaaaaccgccctcatactggatcacctgaccctggccttcaaaggcaaagatccggcgcaccacacggtccagaaaatagcggtcatgggaaaccgtaacaacgattccctgaaagctgtcaaggtagtcctctaaaatcgtcaaggtctggatatccagatcattggtgggctcgtcaagcaaaagcacattaggtgcttccatcaggatccgaagcagataaagccgtcttttctccccgccggacagcttgcccacgttggtgtactggacacttgacggaaacagaaagcgttccagcatctgggaagcgctgatgctgccatcctttgtcttcacatattccgccacgttccgaatgtagtcaatgacctttacgctctcatccatgtcctcgctttcctgggaaaagtaccccattttcacggtctgacctatggtaactgttcctgagtcaggttccagccagcctgctatgattttcatcaaggtggattttccgcttccatttggccctatgatgccgatgcggtcgtttttaaggaaaatatagttaaaatccttcatcagcaccttttccccataggccttggagatctcattaagctccacagtagtccgtcccagacggcttgctacggaatccagctccacgttctgatctgtctgaagccccttttggtcacgaagagcctcataacgctgaatatgggccttctgcttagtggaacgcgcccttgctccccgctgcatccattccagctccaccttaagaatggactgacgcttccgctctgtggccgcctccatatccatgcgctctgctttcagctttaaatatacaccataacatcccagggtgctctctctctcgcctccgccgccattcaccttgttttcctgatagctgtaaagctttcccttatcaagctccacgatccggttggttacgctgtctaaaaaataccggtcatgggtcaccatcaaaagtgcacctttaaagcgccgcagataatcctccagccagtctgccatgctgctgtccaaatggttggtaggctcatcaagaatcagtaaatctgtggtcccaagaaggacactgactaatgccaccctttttctctgccctccggacagggtttccaccctggaatcaaagtccgaaaatccgagcctggtgagcatggactttgcctggctttctaaatcccatacatgctcatgcccctcattgtccctgacaatgctttccaatatggtatccccttcatgaaaccttgggttctgggacagaaagcggatatctaaattccttccctttaccacggtcccctggtccggcacctcaagacctgccacgatccggagcagtgtggacttgccggtcccgttaatgccgatcaggccgattttctccccctcattgatgctgaagctggtatcatcaaaaagcagacgctccgtatatgattttgttaaatgttcaatggtcagtaaattcattccttatcgttctctcctgtttggttcttctagcggatcacaagctccacagggcagtgatcagagcccatgacttctgtatggattcccgcgctcacaagcctgtcctttaagctttctgaaacgcagaaatagtcaatacgccaccctgcgtttttctgcctggcgctgaaccggtaggaccaccaggagtatatcccttcctgctccggatagaaataacgatacgtatcaatgaaaccgttttccagaagaatggtgaatttttcccgttcttcatcggtaaagcccgcatttttacggttgctcttgggattctttaaatcaatttccttatgggccacattaagatctccgcagaaaatcaccggctttttctcttccagcttttttaaataggtaaggaatgcctcttcccatgtcatccggtaaggcaggcgggccagttcattctgggaattgggagtatagcaggtaaccacgtaatattccggatattccgccgcaatcacccggccttccctgtcatgctcctctgtgccgatgccgtaggccactgacaaaggctcttccttagtaaacagggctgttccggaatagcccttcttttgggcataattccagtattgataatatccgggaagatcaaggttgatctgtccctcctgaagcttgctttcctggatacaaaatacatctgcatccatttctttaaaataatccaaaaatcccttctccacacaggcacgaaggccgttcacattccaggaaatcatttttttcattgtttttcacctcggataaaagataggaatagtatatcattttcccggagattaggaaagggaagaattttaattcccagattctgctttaaaaaaacatgactttccttatttcatttatatgatcaataataattacgccttaaacggaaatatcgttgacgaatcctcttcttttgagatattataatgatattttaagggtacacgagaactgtgtttacacaggaaacactcccaggcttttatgatctggcggtgtcagttcataagctatgacgaataacttaacagaatggtcaatgagataaggaggagtatatggaatatcgtttagggatcgatattgggggaacatttattaaatatgcgttagcagatgaaacgtataatatagtagaaaggtggaaagccaaatccataaagtttgacagcatacatgaattttacgactacatatgttccaatattaaggatctcaactcagtaaaaaacataggaataagcgctccaggacttattgatgaagactctaatgtgaaatcttatgctgcagcaaatgtatgcattatgaaaggcagcaatgttaatcatgaaataggaaaaaggacaaataaaaaagtggcgaccatcaacgacgcaaaagcagccggcctttgtgagtttaaaatgggaaacgcaaaaggaagcagctcctccgcatttttaattatcggtacaggtaccggcgggtgcttatgtgatgaaaaaggcgttatatatggcaaagatggctttgcaggagaatttcaccatctgccgtttttaaactttgaaaccggaaagattcttagacagggtgattatgcttccatgtttgctttaattgaaatatttaataataaagcagctttagaagatcaggcggtctatggaagtgaagtatgtgaaaagtacttaaatggagacaagacagccaaggaagctgttgatgagtggatcaatcatatctccattcagcttctgacgatcactgtattttataatccggaaatcatatgcataggaggagggatatcggaagagacctggtttatagaagctgtcagagaaaaatttgataacatatgcaagaactattttggagacgcagaatttataacaactaaaatcgataagtgtaattttaacaatgatgccaatatattaggcgctataataaacgtaaacgaaatgcttacataatttaacaatcaagataatgaaacagcctttcttttccagcatgggacaagatgatcttaagaacctgaccgaggacaccctcagtcaggttcttatcctatctcattatttcaccttttcctgccacttcttccgttccacaaaccgtcccatgaaaaaggccaggacgcctactccgattccggtctggacgcaaaaaagcaggctttccacttctccgggaagctctccgtctatgaaggtttccattaccggggtaaaccatggctcatattccgttccctgtatttccgatatcatctggcttccggcatcatcggaaccgccgaattcggctccctttaaggcaaagagaggtaccgctgcgatgaggaaggctaaaatcaggagagcagctacgatctttttatttttactggtcatattactgaacctcctttgaaaatccaattgccttaagctccggaagggcataagtttcaagggtaatgatgatcactgcggtgaggatcccttcaataactgcaaggggaagctgagtcggagcaaatactcctaaaaattttacggcagaggcaaaaaccccgcctgtttcagacggataggccaacgcaagctgaatgctggtcacacaatatgtaaacagatcaccgatcatcgctgccaggaaaatactgaccagcttgttcaccttcagcatctttaataatttataaattccaaaagacacaaacggtcctgcaatcgccatggaaaaggtattggctcccaaggtggtaaggccgccgtgagccagtaaaatggcctgaaagatcagcacgatcattcccagaatgctgaccgcagacggcccgaataaaatggctccaaggccggtccctgtcatatgggaacagcttcctgttaccgatgggatctttaaagatgatatgacaaaaataaaggctcccgacatggccaatatggtgatggtcctcctgttctcctgaagcgtttttctgatggagaaaaatcccgctgccagaaacggcacacagacagctccccaggcgatacagtatcccacaggaagatacccctccataatgtgcattccataagcacttggaacaattccaaaggccagggcaaatgcaatgacaagtttcatgactcttttttctttcttactcattttcattctcctttccgttttcccacccagcttttttggcagagcccactcctctttctcaggagaaaagggatacccgaagggtgttccaataaaataagcaccaaattccgatgattcccactcatcagaccggcgctcacagggtaaatctttgcacaacaaaaagacttcccggcatccggtcatcgctcgtaaccgaatgcgtcgcaaagcgaaaggcaggtcttctgactcgtgtatcttcacagcagctcctcttcccggtttcccagtgatttattgagccctgctccccacttacagcggcgggaccgtaagggatttccacccttttccctattatcctgcggagaattttcacaggcacctttcacatgatacgatagtattgtagctgtttcatacctttctgtcaatttctttgtgtttttaagagcatttccagctccccggcatccttggggcaaaccatggcttcttctaaaacgtgatgcctcaccaggctgttgtagacctctaaaaggaccggtctttttaaattggcctgatttaatacttcatcatccttaaacacttcctgcacaggcccgtctgcaatgatgcgtccgccggcaaaaattaccgcccggtccgcccatcggtatgcaaaatccacatcatgggtggaaatcagaagagttttccccactttgttcatcttatccagaataccttccagtatttccacattcaccggatccagggaggccgtcggctcgtcaaatatgaccacctcagattccatggcaatgatatccgctatgctgaccctctttttctctcctccgcttaaatagtgaggcggccggtctctcatttccgtcaaattcatgtattccagagcatcctccacccgctgcttcacttcgtctcttggaagctttaaattcataggcccaaaagacacctctgcagacactgtggaagcgatgatctgattgtctgcatcctgaaaaacgatgcctacattctttctcagctggtttaaatctttttttcctatttcctgtccacggtaaaggatcctcccggaatccggacggtataccccgtttaaattgagaaaacaggtggattttcccgcaccgttagaaccgagaaccacaatcctttctccttttctcacagtgatattgatctcctttaacacctgcttaccctgtccataagaatagcataagttttccgcctgcaaaagaatctcctccatctttcttcacctccctcctatgttgtctccgccagatagccggttaagccagtaaatgtacggataaaagaaccagaaaataaccggcggccccccaaagctgccatccctttaccttcttttcctcctccagaaacaaaagctctccatcataacagcgggcggtcagcgcatcataataggtattggccttttttaaggaaaccacaaacagatttccagccgtgcttccaaaggaacggcaggatgtcttaaaatcgcagtaacccattctggactcggctgcctgcttcatggagcactgggtatccatcatcacaaagataaagcggtaaatcatgttcatcagctccaaaattatctttggaacatgaagcctccggaatacacagatgatctcgcttgcaggagtggaaagcaccagcatgtacatggcgcttaaggctgccagtgcctttaagatcagtcccagggcaaggcctgttcccccttccgtcaggtacagataaactcctccaacggatacaaacgcctttccataaggtaccggcgacaatccgattacaatggccgctgttcccaaaaaagaaaagtaaggggatcttaagaagagtcatataattcctccagggatacccacccccaatatggtaattgcagccatcgtcaaaagcaccaaacacgataccttctcatcatccgcccctatgcaaaaaaacagggttaacacagccactgctgccttaaactgggaattccagcctttcatccgggaaagataggcataatgatcaatggtataaataattctcacctccttttcaaagagattatacgccataggagaatattgtgcaatcatggtccccctattaagaaaaaaatccttactttttataaactaaagcccccgaacagatggaatgataaccagccgtccaggggcatatctttttaccggcctgtttccgcttataatttcggagtcaggctttatttttatggttgggaaggccttttcccgctcctcatgactggaatactgtcagtcatctttgttcccggttttaagctccggagagcctgccccaagataaccgtggctttttccttcttcactgtctgtaatccaaaaagcgtatatggaagcattgtgcagaataaagcggatccttattttgtctggactcactccacttaagctttgtttatcccgccaccttatttgaaattttgtcttatcttccgtcatcacacagcaatcctgcctggagtatcccggtatcacattaccttcctgatccaggatttcggctgtcagccttccctctgtgcagttcgcatttacaaataagaattctccctggtattttaatacctctgtcgtcaaagttccttctgagctttccgccttcattgcagcgaacccatcccgccttagcctggcaacgcccactgctcctccggaatacttatgacttccaaaattaggagacttcccagaaaaggcggaataataaaaatacagctcatctcccaccactgtgcagatcccgtttgccggatgaagatatccgtagtcccagcgtccttcctgccttgaggaacttataaaatcctcgtaggaaggtctgtcaaaatgaaagccatctctgctgaaggcaagctttaagtcattgattttcggcaatccggtggtttcacatacaaaattagggggcccataaatacggaataaatgctcagcattacactttcataggccactgcatccagattatacaactgtgtataataccctaagtctctgtcgggtttatcataaatatcggttctggcccaaaagcttaaatcctcctttgaccactgactgcccttataaaagtcatccgtctcataatagctgcgcactctcactctgctgtccagctctgaaaaggtcctcatactgtaaatccactttttacggaatggattataaaaaaatgttgtattatcccctgaggggcttgttttgcaaacctcagtccagtgtatcccgtctgccgacttatataataccgtaatttccttaggcggaactgatgtgggatcatcatgtgcgtgcttgggcttaagatgataatatttaaaatcctgagaaaagcaccggtaaaataccagcattttatatttctcatccggggtttctgcatactcatccaaccaaacggcatctccatccctcagataccccggaatgtgtttcagtatccggtcggaatgaccggaaggatcaatctcacttaaccgcttccacttaaatccatcatcactttctgcataagcgctgccgtcaaaccagcctgcatgataccacattttaaatttatggctttgagcatcataaaacaccccgccattaaaagggcaggcacatgtgcaataaccatcattcagctccatcgtggtctgaggccataaaacaggctgatccgatacttcaggctttccaaattccctgaccagatctgtctcgctgatgagaaaatcatctacaaacaattgtctgccaaccgatatgtcaatatactccggcttgtcctgaagatatagaacttttaagggcttgtcaagcgtttcctctttgttatgaggaggccataaatctggcagtgttatgttattatataatcgttccatgatactccttattaatcattcattattcttccgtcttataaaatatataggtcaatacaaaagccactgcaaaaccaatggcacaagcgattaaatattttcccagctgaccatttaaatacagcaggatacctggtaatgcagttatggacatacctgttccagcaagtcccacaagagaggagaagataccggcaacgccgcctccaatacaaccgcatacaaacggggtaagcctgggtaagtttccgccgaatattagcggctcggtaattcctaaaaatgcaggcagaaccgatgtaagatacagagatttctctttcttatttctcgttttcaaggcagctgcaatccctgctgctccctgtgcaacaatggcgccgcataccagtgcattaaagggattggcacccgtattggccagaagctcaacctcaagagccttaaacgtatgatggagcccggtgatcaccaccgcctgctgcaatgcaccaacaataaatcccccgattccaaacggtatgttcatcaggacggaaattgcctctaccaatcctttttcaataatatgcatgatcggccctattacaaccagccctatcaccatgctggaaaacagggtaacaaatggagtgatgatcagatccagaacatccggcacaacctttctaagccatttttcaattttagctgaaataactccaagcattaatgcgggaagaacggatccctgatagcctaaaattggtatgttcaaacccagcaggcttaaataaatcggttcgatttttccgctggccacctgattggcattgggaagctgaggcgccaccagcatgagtcctattactatccccagtgcaggcgaagctccggaccgtttcataactgaatacgtaaccagtgccggaaggaacgcaaatgcagtatcaatcaatacctgggacaaagccagaaatgtggggtccaattccaccccaagattagtaatgaggctgcgaaggcccataaaaagaccagttgctactaaaatcggtataataggcagaaatacatctccaagcagcctggatgccttctggaatacgttcatgtgaaccgctgcggcatcagattttgacatcatatttccactgtccatttttgtaatatccattacttctgcatataccttattaacaaaacccgttcccagaataatctgatgctgccctgatgccagaaagcttccttttacaccgtcaattgcttctatttcctttttattaaactttgtttcatccttcagaacaagtcttagtcttgtagcacaatgttctacgtttaaaatattttcctgacctcctatatggagcaggatttgttctgctgtctgtctctctttactcattttagcctccttgtttgtgcaacaatgtacgcgcgttcatttgcatgtataaagaatataacataaacagcaagctgtcaagacggcacatgctttttatctatgatgacatattttccttagcttttttgtgctatttgtataatcctctggaagttgattcacgtattaccagtatgggagataagtttatcagctcctcctctgtatttccgttaatgcagttaagaaccatgctgaccgcattccctgcaatttcttctatgggtgatgctactgaagacagggtggggatcatttttctggctaaaagcgtattattataaccgcagacaatcacatctttcggtacctgcagtctatgttcagccaatgacttgatcacatcactggccgcaatatcactatgggcaaaccatgccgtgactttacctggatcatgggtcttaaaatactggctgatgatttcataagccctctggttttctactgtctcatgctggttgcattcaaggacagcttttaatttcaatccgtttttatcaagctcagaccgaaaaccttctaatttgttgtttccggccaaagattttaacggccctatataaccgatatttttatgccctaattccaaaaaatgctttgctacctgaatgcccccttcttccgaactgattatgatatttttcttttccgtttgtttaaaaaggctgacaacaggaatattaataccgctgtataattttttattgggtgttcctatgggccttacgatgatcccatccactttgcgccttttaaatccgttaataatattggtttccctggctttttccctctgggcatcacctaaaataacattatatccgtatttctcagcctcatgtacaattgccgtcattaaagaggcatacaatgggttcgataaatcagaaaataatacgccgatgatattggtcctgtttcccgccagactctgtgccacctgatttggctcatatcccagtttcttcacccaatacatgacattgctacgtgtttccatcttgatggatggatgattcgacaaaactcttgatacagtagcacgcgacacatgtgctgccttagctacctcttccatcgtaaccatggtcatttcaagtcctttcgctgtggttcattgatccaccttttttctatcatactatttttctgatctttctgaaacctctaaaataaaaaatctttgtgtttcctgagattatttcctctcctctaaataaaaagagacagcctgacaacttaagtgccaggctgctgcctcagtaaaacataatctatttattctcctcgacctgctcctcagtcaaggtaaatacctgtctcttacgagccatctcatcacttgccagatactcgtcataggtagtgatcttatcgatcagctggccgttcacgatctccatgatgcggttagccgttgtctcaacgatctgatggtcacgggaggagaaaatcagaactccctggaattttacaagaccattattaagcgccgtgatggactccatatccaagtgatccgtaggctcgtcaagtatgagcacattggcgccggaaatcatcagcttggaaagcatgcagcgcaccttttccccaccggacaatacccgtacctttttcactccatcctctccggcgaacagcatacggccaaggaatccgcgcacataggtagcttccttttccggagaatactgggtcagccagtcaacgatggtatcatcgttgtcaaattccgctgagttgtcctttgggaaataacactggctggtggtaagtccccatttgtaatcgccttcatccggctccatttcccctgaaaggatcttgaaaagaatggtttttgcaagttcattgggtcccaccagggccactttatcttcacgggttaaggtgaaggagatattatctaaaatcttgactccgtcaatagtctttgataaaccattaacagacagcacctcattgcctatctcgcgggccgggcggaaatcgatatacggatatttcctgctggatggcttgatgtcatccagctcgatcttctccagggcgcgttttctggaagtagcctgcttggacttggaagcattggcggagaaacgctgaataaattcctgcagttccttgatcttttcttccttcttcctgttggcttccttcatctgctttaccatcaactggctggactcataccagaaatcatagtttcctgcataaagctggatctttccgtagtcaatgtccgcaatatgggtgcagaccttatttaagaagtaacggtcatgggaaaccacgattaccgtattttcaaagttaatgaggaattcctcaagccatgcaatggcatctaaatccaagtggttggtaggctcgtcaagaagcaggatgtccggatttccaaacaatgcctgggcaaggagcaccttaacctttgacccgccgtccaattcactcatatatttgtagtgaagatctgtctctattccaaggccgtttaagaggttagccgcatcagactccgcctcccagccgttcatggtagcgaattctccttccagctccgctgccttaatgccgtcatcatcggtgaaatcttctttcatgtagatggcatctttttctttcatgatctcataaagtctggcatttcccatgataacggtgtcaagcacctggaagccatcgtatttaaagtggtcctgttttaaaaaggaaagtctctgtcccggcgttataacgatatcgccgtttgtaggctccaattcaccggaaagtattttaaggaaggtggattttcctgcgccgttggcgccgatcatcccgtagcagttgccttcggtaaacttgatattcacctcttcaaacaatgcttttttcccgagtcttaatgttacgttatgtgcactgatcatctttaattccctttctgcaatctggttatcattcgctccggaacttccccttcctgtttacagggaactgccggatggccaaaatcatcaaaataggggtccattggccccttcttctgtcatctctcttattgtacatgaaaatcccgaatttgcaagctttttatcttgaaagaagaagttccagataaattttgcctgcatgtccgggattttcatcatttttcactttactgcttccacccttaaggggaaattggatttgcttcctgcgtcataggtgacggtcacataaatcaccttcaccatggctccgcttccgttgctgtcatcggttgctgttccaaggacatcagaatccagtccctcgcagttgtcctttataaacccaatctctgtgccggattccgttttaatcgtaaaggtgctcatggcctgatccacgacacttccggtcacctcctgcaccttcatgctctcctgtccgtccagcaccaggacaggcttggcatttgcagtatctgaaccggaaatctctcccttataaatgagggaaaccttcacctccggttccagcgcataagaggtctccaccacagtgccgcttaaatcaaaggtcaattccttatcgccgctttggatagacatgttttctaagttgtccccaacctttttgaccgtaccgatgaggatcttaaattcctctccatttcccggcgcctcctggctcacctcttccgtagcttcagtgcttgaagccgtgctttctgttaccgtatttgccacactttccgtattctttgccgattttccacaagccgtaattaaaactgccgcacagacagccaatgctataatccatgtttttttcataagcatcctcttccttcttttctaaattacctatgatttcacatttagtataccatccgattgtgaaaaatctttatcttttttcttaagtaattttaataattacctaaaattggaagtttttgcataaaatcgaggtttgggagacttaccgtctcaccagcttttaccacctaaatgcagtcaaaatgtaatctgacgcctacctatattctatgccgcaatcacccttattttttgtaaagattcctttacttgtaatattttaaaagtaagtataatataataaaaaaggcaatcgccacagggtggttggctaattagaaaagcaaaaaccttcccaaccggccaaagtacagggaaggctttttgtatttagcgacacgtcaataagacgaatgtcagcagtgccagaaagaacatgccaaaagacattaaatccttaaagtcaaaatacttcatgagcaacacctccattctatgtagaatcgaggcctaccatcctatacacgattgccagcagtttgtacctgccagtataattatatgttccaacttaaggctgtactattaataatatcttacaaattccaatggaccctattcagccagccccggatactgcagcgctccatcctgatcaggcgtgagtgtcacctgcttcgttgccatttttctgtcctgatccagaatccaatcattccggatcggttggccagtatctcccaggtaggacctccagccgccttcctcttctatccagccggaatttaagccggggtcctgcaaacaacgctgtattaaaaacattccaggtatgctgggtttgattctatgcataagggttcgggcagatcttccccgtcacatcgtaatggcggatcacctgcacagcaggtacattatatttatccatcagttccttggcgttctggaataccttgacccgcttattctcttttgagcttctcaaattccttcacggcctccaaagctgctgaccttgctaactgctctgctgtttctttaatcacccattcacctccctgctgtcaatatcttctttcttaccttgtcccactctatgaataacagatctgtgcaaagcaccagctccttgtcaacctcaaggaattaatgtttcgatttttgtcatctttgcctcaccagctgctgccacttaaatgccgtcaaaaaatgttagaaactgctatgtaaaaggcgggtccggaataccggacacccgcctaacatcatctaacaatcacattcgttgttgcaatcatcttcattaatcccacgacaaggagcatttctacaatcatcccgacatctcttgcaattacatcttcttttttcctctgcacaaggatcattatcactacaattattccagcgcctgcatctgcatacacatctgcacacacacctgttatctgaacctgagttagagcaactcataaaacaacacccccttgtttttgattgcactatattatatgggacaggacggaaaagggtgtaaatgcagaaaacaagtcctaaatactgtaataccccgtccctggtctggaatgagcatcactccatccccggccgcactgattccatattcgggcctcctggacactcacacttatttaggacaggttgaagttaaaatagacaagccggaatcccattacatgcagtcaaaaaatactacccctgaaacatccataaacagaaagtttcaggggtttaattaaaatctttatccttttgaatttttcgatttctacagtatttcaccgtacctgcccaaaaagctctgcgtacgtaaattactggaggaaaaaacttcctcaggagttccctcctctacgattacgccgtcagccataaaaataactctgtctgaaatatctctggcaaaagccatctcatgggtcacgatgaccatggtaatttgcatatcagcaagggatttaatgaccttcaatacctcgcccgtaagctccggatccagggcggatgtgggttcgtcaaaaaacaggatcctgggatttaaggccagggctcttgctatggccacccgctggcactgtcctccggaaagctggcagggataggctgctgccttatcctccagccccattttccgaagaagctccattgcttctgaaaaaacctcttctttatcccgtttctgtacatggatcggcgcatcggtaatattcttcataaccgtcatatggggaaataaatgaaagttctggaacaccagaccgtaatttttctgtatttccttccgcttctccccttttgcataaacggcccttccatcaggcccgttccatgcggccttctctcccagataattaagctcgcccccatccatctcttccagcatggtggcgcaccgaagcagggtagattttcctgagccggatggaccgatgatggatacgatctcgccttcctctaccgacagggagatatcgcgaagcacgccctggccatcaaacgcttttttcacatggttcatttccagtaagtacatcatctcttcctcctattgataatagttcatccgtttttctatgtattccatccccaccgccacgataaggttgaaaatgtaatagaataaacctgctgcaacgaaaggaatcagactagtctgggaagaagccagggccttggcaactgcgaacatctccagaacgctgatggtaaaagccagggaagtgtccttgaccagggtaatgacctcgttggtcacagacggcaggatccgtttcaccacctggggaaatatgatgcggaaaaaggtctggggctttgtatagcccaaaagctttgcagcttcatactgtcctacaggcatggactggatcccgctccggtatatttccgcaaaatacgccgcgtaattgatgacaaagccgatgaatgccgcccagagacggtacccatttcccacctttaagccaaataagtaataagggccgaagtataccaccatcagctgcagcatcaatggagttcctctcatgactgaaatatagaatttaacaatggcctgtatgacagggttctttgacatcctcccaaaggataccaaaagtcccaggggcagagaaaagaccagggtcaccacaaagatctggatgctgacccacattccccctgccagttgtgataatatcttcgttaaagtcatgatttctcctccatgttctctgaaaaactacaagatccggcccatggacacgggaccggaacccattttattgctttattttttaaccgtagttacatctttgccgaaccatttttcagaaatcttcttaagtgtcccgtcagctgccatggcgtccaactgttcctgaacctgatctcttaatgcatcattgcctttcttaaagcctacgccgtattcttccgcggcaagagcttcatccagtatgataaaatccgcttttctctgctcgatctggtatgccgcaacaatcacgtccatggcaatggcatccactgcgcccatttccagatccatgaatgctgtgttgtaatccggcgtagtctgaagggtcccaaaggtaccggtcagcttttcatccgcctgaagcgccttttctgcggaggaatccgcctgtacctcaacgatcttacctgataagtcggccagagcattgatgccggaatcttttctcaccacaaacacctggctgttttccatgtaggggcttgtccaggtgtaaccttcttcacgccctgttatagtaaagccattccagatacagtcaatatttcctgattccagctccatgtccttggcatcccatgcgattggctggggaacatacttctttccgaggcggtttgccacctcttgtgccagctctaaatcaaagccggtatattctccattatctcctacaaagcccatgggcgggaaatcctggtcaaatccaacggtaaaggtgcctgtaccggcatcttcctttttgcctgcttccgtttcctttgcagtctctttttctgttgatgccgccgtatcggaagccgcagaagcagtcactgcattcttttgcccggagcagccgctaagcaggactgccgctcccatcactgctgctattaaaacctttttcttcataattgcatcctcctcttgcttttcatgtgttaccatggtagcatagtaaagtgtttctgtaaagaagaaatttgcagttataaaaatcaggttcaatagaaagataaaaataatatcaggatgagaatcacggccgcagctcctgccagaaaaaccggacctgccgtactccctccctttttaggaaataattccggttccgcaagcattccccatggactgagctccatgatccccagaggaatcccgcctaaatcttctcttcccataaaggaaagaaattccttccagtcccgttccacgatccgctttccctctttccagtcttcccttggatcctttttctcttttgtaaaaaaggacccggaatcttctccgccttccagacactccctttcctttaagaactgctgataggcatgtcttatccccttatttgcggtctcccgaagatccctggtggtctgatagagattcatcatataatagtagaccttataagcagccctgggctggaaaggggtgttcctgcttcccggcctttttaccatgttttcagactgtttaaacgcttcttgtatgtaaaagtcgatcattcggtcgacggcttcccgcaggtcggcagccaaccccttattgatcccggaataggctccataggtttgggatttaatcgccatcagcgcggccaggaatccataaagctcctcacttcctccggaaagaccggaagcccttaataaatttcccctgcggttcatatacccggcaaaacgctccgccaatgcaagatcagcgggagaataaacctcatttttgcctatagaggataaggaagtctgggcgccatggacttgattcaccttagctcctgggataccgcttccttccagagctgatacagacgcttctttccgcatccgttgggcatacaggggatcattctttatccgtccctctccggcaggctggtagatcattccctgttccccgtcaactcccgattcattgacaggtgttctgatgcttcctggatttaatgcagccgaatccccgctcttttccggctgtcctttaaaaaccctttccagctccctgccgcttaaagtattccccgtaacgccgcggtaaagcgcagcctttagggctgtcatagagctttgaggcccgaaccttcccagaagcgtttccagctctcccatgcgcgcttccagcattttcataaggatatccgacaaggcagcttccagagcagcaagctgatcctcctgtactcctgctgtggtatgttccaggatggtcagaagcaattccttgtaaatcgctgcaagactgtccagctcatcggaaaaagaactgaaggcagacggactccaccccaggatatccttccatgccaggtctgcttcttcctttccccacattttatcaagatcagaaagctcctccttgcccagcttataatacccgctttctcccgacagggcggctatgtcccggcccggtctggtttctttggtttctctgctgtccccgctgccttccccgctcttttgttcatgacttttctccgcgttccggctcagctcctctataaactgctccccggcccggatcctttcccttacgtccgcttcttcaaccgccctttgcatatccccagccccaggctcgcctatgggagccccggcaaccggcggatcctgtgcctttatctccatgttttctcccttttgggcttcttttgtaaaagtattattgatctgtcagcaatcagtctttttcatcctgataaacaatccgcccgccgcagatcgtatatttcacctttccaaacagcttttctcctgtaaacggggagttggaagatttggaaacgtattctcccacaatccattcctcattgggatcaaaaatcaccagatccccggcccttccttcctcaatgaggccgaaatccagccggtacagttttgcaggattgaggctcatcttctccatcagctccatcatagtcagatgtccgggccgcaccaaatttgtcactcccagtcccagggctgtttccaggcctatgataccgcttggggcttccgtcagtttctttgatttttcctcggtgctgtgaggcgcgtgatccgttgcaatgatatcaatgctgccgttctttaatccctggataatggccttgcggtcctcttctgtccgaaggggaggattcattttcgccagggtcccatgctttaaaacagcttcctcagtcagagtaaaatgatgaggtgtcacttccgcatatacctttgctcccagctcctttgcaagcttaaccatcttcacagaggcggcggagctgatatgctggatatccacggtggcaccggtgtgaagggcgatcatgcagtctctggcaacaaggcagtcctctgccaatgccggagagccaaagatcccaagctcagcagacacctttccgtgattgatcccattatttgtgataaaagcagggtcttcctcgtgaaagctcaatggaacctccagctttgcagccatttccatggctttctttaccagcttttcatccagcaatggaattccgtcatcggtaaatcctaccgctccatgggcctttaattccaccatatccgtcagctctttcccaagaagtcccttggatactgcggcagcctgcagcacatggatgcccgttttcttcccttcccgttccacatattgaagagtttccacgttgtccacaggaggcttggtatttgccatacacaccaccgcagtaaaccctccttttgcagccgctctggctccggtctggatatcctctttataagtgaaaccaggatcccggaaatggacatgaacatcaacaaaccctggggcaacaatgaagccggaagcgtcaatcaccacatcctcttttgaagttggaaaggcatccagcttaagctgttctccaatacctgcaatcttaccatccgcaatgcagatgtccatatttccttccacctggttcccaggatccaccacgtgagcatttttaatccaaatcatcttctattccttcccttctcttttatttctgtaaactacaaaaatcatgctatgcaaatgtcatatgcctgcagattgttacgggatattagatttatcgtccgtttgtacctgtttctttgcagcaaatttaaaaaaaccctgaggcagctcaaaaacaaacacaattccaagtacaatggcaactgccaccttaagcgcaagaaacccggtccggaccgccaacgccagttcatccgtcacaatataataagccgtccagtataatcctgcaccaggcaccaccggaaaaataccggatattaaaaatatggtgacagggcaccgttctctcacggcaaatgttctggaaagaaggatcaccacaatggtggccgccaaagcagccgacggagtcgtcaggattttcacaaaccctgcataaaccagccagcctgcccctccgatcagtccgcaatatggataaaacctcctggggaccccgaacaaaagggaaaatgcaaccgttcccacaaccgcagcggcggcttccgcaacagtgctcatagaagcacacctcctgtcagatggcggaacaggctgaacaccagtccaacgcccatggcaatacagaaaaataccagcagcgcatcaagcatccggacggagccggagatataatccccgtcagcgatatcccgaatggcatttgtaaaagcaactccaggaatcagaggcatgatggaaccgatgatcatgaaatttaagtgttctccaaaatggagcagataaagaaccgtacacaaaaaagtcaccagagcgcctcccccgatgatccccacaatctttgagagatgagggacgcttataaaaatcacatatacatatagaagaatcccggtgccaaaagctgagaagctgtcccttaagtttcccccgaacaaatagcagaagcaggcgcttccaataccggaagccagaatctgcatggtttttggttttcccggaataacacggatctgatccagacgccgaattacttcacctggatttaagcagcctttctcaatctctctggaaagctggtttacctccgccacccggtccaaatgggtcccgctcaccggaatatgctggacctttgcaaatatttcttctctctcattgcctgaggtggtaaatatcccattgctgagaacaaaggaatttacggactggatcccatagtggcggcagatacggtccatggtttcctctacccggaaaatctccgctccgttttccaaaagaatgtgcccggcctgcattgcggcctccaaaacctctctctgttcttttagcgtcagctcccccggctgtcccttctcattttccataagaacctgtctcctgcccgatttcaaagcactccccgtcttggcggatatccacgatccggtccctgtaaggttcagaaatatccatttcctttaacttgcctataacggaaaaatcccccagcaatgcatgggaaatgcatggctaacccgggtctttctcatgaattcatcaaagccaaggcagaaagcattttcctgtctggggtccagagggagaaaggccacatcaatatgcttgcctgacagcttgtccacctcttcggaatactgctttgccatatggtcattccagtcgtccggttccccttcccatctccagttgtttaaatccccggcatggtaaatgaccgcaccttccgcttttaaaagaaatgctacgccttcatcggtggagcggaatgtcagaatttctgcatttgcctttccttcctcagaaaatgggccagtgagactgccttctgaaatggaaaagcctttcctttctccgggctttacaaagactgcctcgcttataagctccttgggcagccgtcctttcggaatatcatccgacaggatatacctggttttttcatgttcttttttaaactccagtattttttcagaaaaatggtccccgtgacggtggcttgcaaaaaccagaaggggttttttgtcattgagctttggcagagtaccctctgtataatcaaacagcaaggctactgtctcaagctccaccagaaatgcactgtgatggatataggtgattttcattggaaaaggcctccttttatggatgtttgaaaaaattatatcacaacagccatcactctgcatagcatgtggacgtaaaaagagtggggacaattctcccaatgtcattttgttgagatataatagcaaacgctctccttaagcaggggatatggaaatatttttttcttccttttcctgtgatcacgttgctttgaatcctggctgttcttttaagcctcattaatccacttaaatattatagaaaaaaataccatacaggcctatgcagaaaagtaaaaataacgaacaaaaagtaaaaaataggacgttcaacagtcaaaataaacatgatatgattttatcaaggaaattaaaaatacactttgcacaaagaggaaatgattatggagaaaagcagttttaagattactacgattctgtataagcagcgttatctgtttatgatgctcttgccaggtctgctatggtttgttatctttaaatatcttacatatagcggattacttctggcctttaccaattacggattccgggcagatgttgattttgtgggattgaaaaattttcagcgcttatttaaatcagcagtgttctggaatgcgttccggaacacaattatcatcagcttatgtaatattattttttattttccctttccgttaattatcgcactgatgattaatgagttaaaatcactgacggcaaagcgctctgtccagtttttaatctatatcccttattttttttcctgggttattgtaggagcgatatttgctaatattttatcaccgtcttccggagtggtgaacaatatcctgacagctttggggcgggagccgatttacttttttgccagtaccaaatggttccgtccgattttgatactttcttatatctggcggcagatgggatatggtgcggtgatttatgttgcgaccctgacaactgtggatccccagctttatgaagcggcagccatagacggtggcggaagatggatgcagatgtggcatattactctgccaagtatcaaatcaacaattatcaccatgctgcttctgaacctgtcccatgtgcttaagattttcgaacaggtacaggtaatgtataattcatctgtgtactccgtcagtgatgtgctccagacctacgcataccgggaaggtgttctgtcaggaaatatcgcttattcaacggcagtcagtctgctggtgggaattatcagtctgatcctggtgcttgggactaacatgttcagtaagaagctattggatgacagtattttataacagcataaggaggcctggttatgaagataaaagaagcgagatcccggattatattccgtattattaatagtattattctgatcctgatttgcgcaatggtgatattgccgatctggaatgtcattgttacatcttttgctgaggataaggatgttatgggaagtgcttatttattgtggcccagatccctgaccttaaaaaattatcagaaagtgctgggcagcggatatatgaaaggatttattaattccctttgggtagcagcggcaggaaccggattatctatgctgctcacaattcccatgggatatgtactggcacagaagaagttgttgttccgcagacagattatgaggattgtaacgatcactatggtgtttgatgccggaattatgccgttatatattctggttaaaagcctgggacttattaacagttcctggtcgcttatctggccttttgccatatccacctttaatctgattattgtgaagaattttatgacctccataccagagagtctggttgaatcagctaagcttgacggttgtaatgatttgatggtactgatccggattgtaattccgcttgcagttccgattttatctgccgtaatgctgttttactttgtttcatactggaaccgctatacagaggccgtaatgtttattaacagcaatgaaaagtatacgttacaggtaatgctgcgggctatcgtttttcagggtgacggttcattaggagacggaaacgtagtctataacaatattaaaatggccgttatgatgttgggtatgctgccagtactggttatttatccgttcgtacaacgctattttgtcagcggattgatgctgggcggtgtaaaggaatagagcaacacaattaaaacaaccaattggaaggagagtattaagatgaagaagaaaaaaattgcagcattggggcttactgcagcaatcctgctatcgtcgcttgccggttgcggcagcagcacagccataggggggaatggtccgaatacagcggacgggccccagtctcaaggaaattcgggtgaggcagcaaaggaatcggtcagacttagcttcagttctcctgataataacttcggtatcagtacagatgctgatctgcaaaaagcagttacgaaaatgctggaggagagagtgggtgtttctcttacaaccattatcccccagtagcaaactacagtgaaaaggtagagactatgatttccagcggcgatgtgccggatgtggtatccttgtcacaggttatgaccaagctgcctaactatgtgtccagagggaaactgatgaatctggatcaatacattgccggttctgaaaaattatcagcaattccggctgataattacgatattctgaaaataaatggttccatttatcatgtaccatataatcagcccagagtaaaggttctgtttatgcgtaaggatattatggaagagcatgatattcagctttctcatactccaaccacggaagagtttgttacagaactcagcaagctgaagggaaccgggatcattccatttagttttccgaaatggatcgataatttccagtactttatgaattcttatggagcctatgcaggcatttataaaaatgaagaaggtatgtatgtagatggtttccaggaaccggaaatggtaaaagctctggaatatctgtgccggctctacaaggaagggatcattgaccaggaatttattactacggaaaatgccacaatgcgggaatatgtatacacaaaaaaagcggccagcgcaattgactatgtaatgaattataccaactatctgtcacaatcagaggctgccggtaagtactcagatgtatttccgatttatgcggtaatcggaccagatggagacggcggtggactgaatgaggccattcagacagcgtttgcagtttctgctgactgtaagaatccggaagaggcaatcaaactgatcgaagctctggtttgcgatgcggaggtatactctgcgttctttaatctgggaatcgaaggtcagcattacactttagatgaaaataatatggcagtagcgacagaaaaggccgccaattccggctatacaccaaaatatacttatctgattgaatcattcattgatgatttcagcagcttaaaggtagtgccgccggcagggattgaagcgtctctgagtacccagaatgagatgacagctctggctcagcagtataaaggtcccaaacacgtagttccttctggtatttctgatactcatgaccaggtagcttcttccattacaagtgcctggcaggaagcagtatcacagatagttcttgggactgtgacagtagaggaaggaatggaaaattacagaaacttctggaacagtgttgatggggacaccattttaaaggaattgaatggccagtaattagatcgtgtagctgaagacagaaaaatgagggggtgcagttgcggccttaagaatgtctggttcgctggacaggaaccgctgctgcagaccctcctttactctcatctcttcccaacccatacaggccattcttatatcacaagttgccccataccgcagatactgttataatttttctacagacaggaggatgtggtgtgaaaaaacatgaatatcagttaaagagagagttgcatacctattttttaaaggttctcctaatggccggggttattatcagtgtaatgtttatgacctattattccgtacgtgagacggcagttgtagcaaatgaaaagtattggcggctggcccagtcggtcacttatgctgaccgtatcatggaagagattgcaaccatcggcggttctatttggaccagctcgcagattcagggaattaaggctgcgaatataaatcaacggaattatctgtattaccggtcctgtatggattacctttccaatatggaagccagtgctaataacgtataccggatcagggtctttgaccggacaaccaaaacattgattacttccagaaacggagtcttttacgatgtaaacgaagatgcggctgcttattatcagaattatatggataatattaaaaattctgcctgggtaatggattttaacgaaggtattgttccgcgggaaagcaacggagaactttttttatattacctaagcccaatatattcaattgttaccggagaaaaaaccggacttgtgtgtattgatgtttctaaagacgtattttctgctttaatgaaacaaggagagagcggagatggctttgtcattatcagtgagactgtggaaattccggcaatgcgtcttgcggataatgatattgagtatttaaaggcagctgataatcgtcagagctcaaactttaaattttatgtccggcaccgtccttttcatgctgtataccaacagtctgactactcaggctggcatttttatctttattatccgtcaaccgggatttcctttgactggggtatttttgtaatcgcagtactgctgctctgtgccattttaatttccgcttatgccatgattgtccgaatctcccgaaagagggtagaagaaccgatggaacagcttttacaggcaatgaaagattttgaggaggggaatttggagtacaggtagaaggcggcagccaggatatgtttgatgaaatcttttgccactttaatcatatgtccctgcggacgaaagaattggtccatgagctgatcgtagaacggatccgcttaaaggacggaaaactgaagatgcttcaatcacagataaagccgcattttctgtataatatttttaacagcatgatctggatgacggaacagaaacattacgatggattggagcagatggtatatgccactgccggatattataagaccagtctgaactttggcaatgacgcaataaacctgtttgataatctgaatcaattaaagtattatgcaaaaattcaggaaatccgtttcccggataaatttcaatgtaagattgtttttgacgaagaaatactatgcgattcaatacccaacctgttgcttcagccattgttggaaaatgccattggccatggggcagcggttgggaaagaaacgacgctgatcacggtaaacggttaccgccagaaaggtgatcttgtctttgagattcaggataatggaacagggattgagccggaacggctgaaacagattcaggaagtgctggaacagacggactatcaggaagatgaattctttgctttggccaatatcgctcaaagaatccggatgtcttatcacggaaaaggaagcttgataattgaaagtgtttttggcaaggggactaaagtggtagtccggctgccagaggaggaaagcggatgtacaagttgattgtcgcagatgacgaacgcagcgtgctggacgggattgcggataccattccatgggaggaatatggaatctgcgtggcggctaaggcagaagacggtgaacagatggtcaaggctgcactggaacatcaggctgaccttttattgactgatatccgaatgccgggcatggatggcctgactgcgattcaatgtctaaaacagaagcttcctgacttacagtgtgttgtcattacggcttatcaggaatttgaatatgcgaaaagggctattgaactgggggtaaacagttttgtgaccaagccggttctaaaatctgaagtgatcgagcaggtcttaaatgccagggataaacgaaaaagtgttctagaagcgaaacaggccctggaatctgtgcagaaaaccttaaatccggttctgctcacccccatcgaacggagccttcattacatgaaggagaaaatagatactccgtttaccatgactgatgttgctgaattcatgaatatgaatccctcctatttcagccgctattttaaagaagaaatgggaatttcatttattgagtatgtaaaacagattaaggtggagcgggcaaaagtgtttttaaccacctcgaatatgcgaatatatgagatatcgtcaaccctgggatacagcagtgtgcagtatttttcaaccttatttaagagcattaccggagttacacctcaggaatataaaaacagaaagggataaaaaaatatggaacaggaagtgatattattttatgatgatttttccggtttcaaaatcggggaatttccctatgacccggaccattccgcaatgggtgagtatcagctggtcagccagaacgggtatgcagggaagtgggttgaccaggtatgcaattacagctataacggaaccgggcctacctggattattaccggtgacgggaagacacattatatggaacaaatgcggattgaaaaaaatcatccccatcggatgttcccgacgcttcagaccggactgcctcagtggcgggattatacttgcgaaatcagattaaaacggttatcaaccaaaggtgttgcaggcctggccttttgcatggcaaacagcatcaatacgctggttctgcagatggagaaggggaaaatttcgctggtacaccggcataaagaagaagtacattatttggccggggcggcttttgaaagtgattgtgatacgtggtatcacttgcaggttgtatgcaaaggcaatcaggtcaagtgccttgtcgatcatcaggaattgattgcttttcaatcggctggtctggtggccagaggcggaaaagtcggaattacggctgattgtcccacccaatttgcatcagtaaaagtaacaacagacaaaaatggctacgaacagatacagaaacggatacagcaggaaaaggaacgggaaagggaagtgcagcgtcactatccagggatgaagctatggaagagtattgatttgaaggattttggaaccagccgtcagatccgcttcgggcatctgaccgggaatgaaaagtggcatattgttctggctcaggcgcagaaaagagtcagccgggatgcctacccccatatcagctgcctgaccgccattgatctgtcggggaatattttatggcaatggggagaaccttccgttcagacggaaaagctgggaaaaatatcagctgatctgccatttcaggtgtatgatattgacggtgatggtaaggatgaggtgatctgtgggattaactttgagcttctgattctcgatggagctaccggggctgtcaaaaagaaaataaagacacctctcagtgatgatgatgacaccagtctgatcggtgtgccttttggcagctatgcatttgaccggatcaatccggatggaatccgtattgccaacttctccggcaaagagagaccgtcagatattttaatcaaggaccgctactgccgcatctttgcttttgattcagagctcaatctgatgtggcattttaagagcccattgaatacagggcattatccgctggcaattgatataaatggggacgggtttgatgaacttctgtgcggctatattatgctggatcataaggggaatcctatgtggagttatccaataaaggaagatcatacagatgaaattgttgcaggtaaatttatggctggcagtgacaggggttattttgcctgtgtatctggaaccgagggattttttattggtgattttcagggaaaaattctgacacgggataagatcggccacgctcagcgggtcagcgttggtaattattgtcctgaccgtaagggatttgagctggctgtcagtaatttctggggacatcagggcgtagtatatttctatgactgcttcggcaatccattgtgggaaatggagaacgagcaaaatggcaatgtcctggttccggttaactggaaaggcgatggcagtgatttattcattttaaatgcagatccggataaaggaggtttacataatggtgacggaatggcagcagttagatttcctgatgacggacatccccagatgtgctgtgatgccattgatctgtgcggtgactgccgagatgaaattgtggtatgggattatcaacggctgtgcatttatactcaggaggatgaacaggataaaaatcagtatcagcctgtgaaatatcctcactataatgcttccaattaccgtggtgaatattcctttcctgatgcttcttatattacatttgctgaaagaagctgaaattcattaaggaaagaaccggctgatctggatcaggcagctgaatttattaaaaaaggagaacttaatgatgaaaaagcgatatgttcaggtaggaaccggaggaagagcaagatttttttatgaagctattgtatctacatacaaagaaaccagtgagatggcggcgttttgtgatgtctctcaaaccagaatggactatgcaaataagattatttctgagcggcatggggcggaccgggttccgacctatcactatacggaatttgaccggatgcttgatgagatcagaccggatgcagttattgtgaccagtgtggaccggacacaccatgattacattatccgggcaatggaaaaaggttacaatgtaatttctgaaaagccaatgacaattgatgaggataaggcacaggcaatcatagatacccagaaaaaaacaaaaaaggaactgcgggtcacctttaattaccgctatgccccgcacaatactaagatcagggagctgatccgtgacggagtgatcggtgacgtattttcagtacactttgaatggcttttgaatacccagcatggagccgactatttccgcagatggcatcgtaacaaatacaacagcggcggtctcctggttcataaatcaacgcatcattttgatctggttaatttctggattgacagcaagcctaaaactgtatttgcatttggtgagctgaatttctacggtatgaaaaatgccgagaaaagaggggaaactaatttttattaccgctgtcatggaagtgatgctgcaaaaggcgatccctttgcgatcgatctggaaagcaatgaggatctgcgggaactttatctgaaagcggaaacagacagcgggtatattcgtgaccgcagtgtctttgctgacgacatctccattgaagataccatgggcgtaacggtaaaatataaaaacggagcgattctcacctattccctcaatgcttacatgccttgggagggctttcaagtggtctttaatggcagcaaaggccggattgaaatgaaagcagtggaaaagtcttatatcaatgcaggtggagacaaagcagacgaaggggcattgaccggaaagtcattgatggtttatccgatgttcggaaagccttacgaagtggaagtggcagaaggtgccggtggtcatggaggcggtgatccggtcctgctgaatgatatattcggcaaccctgagccagatccattccatcgggccgcatctcatattgacggagcaatgtcaatattaaccggagtggcggcaaataaatcaattgcttccggattgccggtggagatcgatagtctggtaaaattctaaaataaaaatcagaaggctttctgctttaattaccgccagtttttgctgttcattcatatcatttctacaaaaaaaggacagagttggaaatttcccaaaactctgtcctggaaagcaaggacctgcgtaaaatcaattattaactataagacattagacaattgtccctgccccggaaatttaacattcctgaccgaaccggtaatctgaccgattaatttgcagcctttgtggattcaacttctgcagactctgtttctacatcatctgctgctgcatcttcgctgttttcttcttcggaagactcgtctaaggaaacttcttctgtcttggactcatctacaacttcctctgactcttttgcagttgtagcttcttctgttgctgcttctgttgtgatggatgcctcggtagctgctgttgtttcagcttccttggtgctgccacatgcagagatggatgccatagttaatacggctgctcctgtaagtaccagtttctttgctgttaatttcataataattctcctccttgcgactacataggtgttattgttcttttgtatgccgcggctccatgttgtcctatgtccctgaagccgagtcccagtttagcaccttaagaaaataaagtcaatgttcccattttgccatttactacacttgtaatcaagtaaaatcttaaaactaatgacaattgacgggggagaagtatagctttaaattatgaaattatactcttgaattttttttatatcgatcattccaaatttgtccactccaaaaacatcacaataatcattcgaaaaacaaaaatatttttgttagtttttaccacagtttgttcgacaaaacaagacaattatgtggttaaatcataactttcccctatcatccgcttgatctccttctctggtacggatccgtccatgaggatggtattccagtattttttattcagatgataccccggaagcacgccggaaaatgcatttctccaaaattccacccactccggatcacattttaaattaatgcagaccagtccattccgttcatagatccaggcaaatacctttctgttttttttgtgccggataacggtccactggtggtcatgaaaagggtaatcttcgtaaacctcaggatagcctaagcaataagtaattaattctgccctggttttcattataatctctcccttcctttcccatgtccattgcagatcaagccaatacctgctatacttttaagataagcaaacggataataatacaaacaaaacaggaggaattttatatgttgaaagaactggttaccaaatgccgtaccttccgccgcttttatgaggcagaaaccatttccatggatgacttaaaagatctggttgatttagcccggctcaccgcctcaacagccaattcccaggccctgaagtacaggctgtgcaacactcccgaggaaacctccaaggtatacccgaccttaagctgggcgggcgctttgccggactgggacggaccaaaagaaggggaacgcccttctgcctacatcatcattttatgcgacttgtcccttgggaaaaacaagctgtatgatgacgggatcgccgctcagaccatcatgcttggagccgtggaaaagggatacggcggatgcatgttggccagtgtccagagaaatcatttggcagaagccctctccattgatacttccaggtattccgtagacttagttcttgctctaggaaagcctaaagaagaggtggtcatggttcctgttaaggcgaatggggatacccactattaccgggatgagaatcaggtacattacgttcccaaaagagctcttgatgatattattatttaggttgaaacaggaacagctcgctctccttcctctctttaaactcttctgcaagagcctgggagagcctggatacctttgactggtctaaatttctggctcccaccggacagacggagatgcagcgcatacaggagatgcacgtttcttcgtcggtttcggacggagcctcgcccggaatggcgtggacagggcattttatggagcaaataccgcaaccggtgcatgcctctcctgctgccggttttagaaggactccattggactttcggtaatccggatttcctttgacaggaaagtctggtatttctatggtggtttctatgttatgaaagcttttaaggatggtttctccaaaattctttatctttccttcatctgtttcatccggccgtcccgcggcatagtggcgcatgatggaatgttctgctacggctgatatggctgctgcgggaataaaaccgttagcagataccagatccttaagctctaatagggcatcctcataatcccggtttccatagactgccattacaatggcaggagtgctatttccatggaatctcctgattttttctgccgctgcggacggaacgcggcctacgtatactgggactgaaaaaatgactaattcatcagggctaaaaaattcgggttctcttcctgcctcataatcagtgatatccatatcttccatgctgaatccaagggcttctgccaaaaaggcggagacctttttcgtgcctcctgttggactaaaatatacggaggttacctttttaatctccataccttctttcctccttcttaaaaccgctgtccgcatttggggcagtattcaaaatcttctgttgtttcgtatccgcagtgggaacattgcttccggttccagtctgaggtcctgtggccagactgcaccagagtcaaatcctgctcactgatttccacggactccctgcggctcagtcttttccctttttccgggtccaactcgtaaatggtattacagcaggacatttgtacgtagtaatgccggtcccattttataatgggaatgaaaaaaatgctgaaatagctgtaggtcataaatacctggtacctgccgtagcctccgcacagaccgcatattactgttttggtgtaatccaatagtttctttccctggctcatgccgcatatgaaaaacataatttcctcctaaaatggaatgttgattttttatgtgtattatgctacaatacagttagaaaaggaacaaccgcccacaaggtggttgaccgttatagaagcagaaattccaccctctcaactgccaagtatcagggtggtttttctatgtatggctacttacaaaatgtaaaaacgaatgtaagtaatgctaaaaggaaaaggccaaaggtcaataaatccttaaaatcaaaattattttgatttttcatagacatcacctccattcttatggaatgaaggacaacacacccggcaacacgattgttccatgttaatattctactataattcaacataactggcaacctgtataagacataacagctatgtatatgtaaataattttctgcaattaaacagactaatattagcctattttaactctctcttaaacccttaatctaattttgaagtattccagtaattcagatagttacaatttggaagatacacgttttaaaaaaatctttattaaaaatctcacttaacaatcctattatttgagatatttgatatatttatttccatttataaaaatagggaacctaatttaaccatttaatgaaaaccattttaatgatattttccccgtttatagatatttaagaatgttattactctttcgtatatttatatatgcttttaccatacctatggattggaacatgttgcatggctgagtagggtatgatactatcatggtaagggataaatgtttcactgcaagagtgttgaatttcttacctttatattcaataatcgcaattaaatctttctgaaaccttggaaacagggatagaaaagccatccatgtaaactttggacggtttgaacggtgccaattctatctttttattagccagccccttgtaggagatagccgattctcttataatttttttattggtatatgaaaattaaaatagcaatggtttattaaaaatataaaagacagaaacgattggatagcagtgcgctatcgtaccaggaaaggaagtgttatcatgccattatcgcaacagcgtctgactactatagaggaatatgaggctctgccccatgatatcagagcagagatttttgatgggcaaattcaatacatggccagtccttcacagatacaccaggagatatcaagagaacttctatataccctgacggattatatcaaacaaaaaaaggggacttgtaagacatattccgctccatttgatgtaaaactgaatgataaccctcttacaattgtgcagcctgatattatcattgtctgcgatagggataaactggatggaaagcgatacaacggcgcacccgattttattatagaaatcgtatcccctggaaatccttctgatgattatattaaaaagttgtattactataaaaattatggagtccgtgaatattggattgtagatcctggtcgccgtattgtgactgttaattactttgagggtaacagcatctcagttcaatatccatttgaggctgttataaaagtgaatatttatgaaaatctgtatattgatttcaaggggattgatcagctgataaacgaataatgaaaatagatgggatttatgagataggaattagataatattggttagcttttttataaaatgaaatgtataagttaaaggtgctgcaaaatgattagatgtatggtcattttgcagcacctgttctatattgccattaagaaattatatcggattaccgtaataactgtaatacgccctgaggaagctggtttgcctgagcaagcattgcctgggatgcctgaacaagaatgttattctttgtataagtcatcatctcttttgccatatcaacatcacgaatgcggctttctgctgctgtcatgttctcgctggttacgcttaagttattaatggtgtgctccaggcggttctggatagcaccgaggtcaccgcgggttgaagatacggagttaatagcctttttaattactgcaactgctgaagctgcccctgactgtgtttcaatatcgattgcatcaattcccaaggcttttgcactggtagaaccaatctgtacagaaagcttgttgaacgaatcagaggtatcaccaatctgaagggtaagtcctgccccctgtgtcgttgcattggcaagtacattggtggaacctgttaccttaacagaaatgccatctgcagcaacccctgttttgccatctgcagtcagcttatctgctaataactttgccaaatcctcactcttatctgtatccttataaagaattttttctgcgccttttgcgacagtatcggaatcactggttacaaatgtataggtcttatccccaacggtaacacttgttccgtttaccatcttattagcatcaaaggttgccaatgtaccggcccctgttgttgtccctgctgttattataagtcccgggtcagaagcaactgctgaagcttttcctgctaaagcaggatcattagcagtgagcacctcctgggctttattggtggactcgctgattgtaaggacatttgcagcggcagaagccacatatttgccattatcaggttcatcagcactgatttttgctgcaagcttactcgctacatcattagcagaatctgttgcgtctacctttacaacttcataatctgttccttctgtctttccttccaagccctttaatgcttcggtaccattttgaatcacatacatcttacttccaacagtgatagcaccgttatggagagatgatccggtagatgttgaatcaattgtaagctttttgctggctacctgataagatggatcttttgctgccacataacttgttgcctcacctgctgccgttccatatccaatgggactttcagttgttccatcatacttttctttcattttatctatggaagcgttcctgtcagcagcatcaaatgctgttgcatcaaagcctgcggcttcgattcccagtttgctgccatcaacatgtgaagctgcatcaaatgttgtaccatgagccttagcagtaatggttacaatattaccatcaacagttacatcgtagagatcttcaaacttaccatttgcatcagtgccttgagagtcaactccacctgctaaagccgttgcaatatctgctgtattaaaatctgcacctgcagcaacagtcattgtaacagtctgagtggcccctgtattgtctttgtaggagagaacaatatctttgccggcagcgttattattcgtgatatctccaacatagaatttagcagaatattttgtttcatcctctgccggattcagcttaccatctacatttgtagttggggcaaatgttccgatggctggggccttggcttcatttacagtagtagaagtaatagtaccaacctcaattgctccttttgatgcatttatgctgccatccagcaggttaattccattgaagtttgtgctctcagaaatacggttgatctcacttcttaaagagtttacttctttctgtagattttcgcggtcaacttcattctgataagtaccgttcgcagactgatcagcaagttctaccatacggtttagcatggaatgaacctctgtcaaagcgccttctgccgtttgaaccaaagaaattccatcattggcattcttctgagcggtatcaagaccagtaatctgtgctctcatcttctcagaaatagcaagaccggctgcatcgtcgcctgcgcgattgattctaaaaccagatgataatttctcaaggtttttgcttactgagttattattatttcccaattgtctgtgtgcgtttaaagccgtaatattgtgttgaattctcatatgtattacctccttgaattatgacggggacatccttttcccccgtgtttctttttatctatcccaaactccccattcgggccctgaatgagaagctgaaaccagttttccttttaccatctcatgcccttttctttcaagcgctttaagcattgaggcattggatggcgtttttcataaatttcacctctgacaatagaaatgtcctttggggcgtcaatagcaagtcttaaatctccgtccactgaaaccacctgaatgacaatatctccattgatgacaagatactcacccggattccttcctaacgataacattcgcatcacctccttgttattctgcgaattacactttgttaaaaaattgacatatttacaaatattcccagaatgtgtattacaacaagtaccttttaaatataaaaaagttgatttagacaggaaattaaaaagatttttaaaaaattccttatgaaaccatttggaatgacgatatatgaaatagaacagaaattgcgtatttataggggaataataaagcaaatcatctttctttcatgttcctataatacacattatcagaacatacctatcctgcgattccttctatgaatcaagttcagaagaatcacaggtttttttataaaaaaaaagcgcagcaccatgaccatatcctgtcatgatgctgcgccttatttaccatgtaacgatcctgtcaatgaggctttgctgctctgtagccgtccttctcaaataaatacgggtggtctcaatgctttcatgccccattaaatccgccagcaatgaaatatcattgcatttatccagaaaatttttcgcataccggtggcgaaaggaatggggatagacaagctttggatcaatcccgtacttttccgcataacgtttcaattgcagcccgatccccctggttgtaatccgttccccaaagcggtttaagaacagatatccgcaggtgatatttacttccttcagccatttcatactctcctcctttaattttccgggaatatagagcctccggagttttcctccctttgaataaagatccagataccccatttccacatgctccaccttgacctgtatcaattcgctgactctggctcctgtggcagccaggtaccatacaataaaataccactgcatgtttccatcctgctttaaccgtttttttaaatatttataatccgcattgcttatcacattttccagaaaatttttttgctgtattctgacattttttaactgcagcggttcctgcttgatgtatagcagatatttattaatagcctgaacccttaagtttaccgtcttcggcttataatactccattaaatatcctttataagccagaagattttctttacttatgtcatcgtaacgggtaaaataaacttttatcgcagacatataagaaaatatggtgctgtctgataaattttcattacgaagatatgattcaaactgcatttgtgtttccatctgtaatcctccgtacactaaaattgggccccccatgatcctttatgttgaggatattataaaattcaagtcatatttatccttatgtaaaaaaagaaaactccctggtatgcccaagtagtatcccgtaaaatgagtggaggcaccacagcacaataggttatcccatcatgctgcaatgcccctgtttaaatcatctgctatctttctgtgccggcttctgaacgtccataaaaggtaagcaggtacaacccgcaaattcctaccagagcatacacgattcttgtaatccatgtcatgctgccgaaaataaatgacaccaggttgaaattgaagaaacctaccagcccccagtttaccgcgccaataatggctatggtcagagctgtataacttaatgctttatttcccatggcactacctccttttctttcttattatggagtagctttctggtttttatacattattttcccaaactatcgatcctggcccttatgtcattctcccggtctttaaataacaaccgctcattgtattgataataccgttcacaatcatactcttttaaaaatttgacgctgtaatatccggtattcagctccgtcagaaacaccaccatttcctgtccgtctccaaaggctgcttccatgaaatcaaaggcgtgctccagggactttcctccctcttccagaagagcctcatacctggcattttccccctcaaacatctcccgtatccggccccaggctgcctcgttctcttcgatcccttctctgcgaagggtttcctcatactgaagaagaagggcttccacgtcccggcgcaaataatcttctcttctgtttaaaagacctgcgtttcgtttcctatcccaatccccgctccactgatcccgtaaaagagccagccggtccgccatggaagtctccggactgtcaccgctctccggactaattttcttcaactcttccattaaaaggccggttttgtcttcctgctgggataagtcgcggaagctttgtcccagtctggacaataaaaggccgatgacatttaatttctcgtcaaatggtgcccgttttaacctgttgcacaggctttcccggatgatgccggacagaatttcatcgatctggtaatcatcccggtacttataatatatctccagataatttgtaaagtccttggcaatcttaggaaactggatatactctcccaccacatcccggtccgccttttttcccaggcgctcataaatctcaataaatttcgataagtcttcccagcccctgggtgtagcaaaaaattttccatccacagtggtttcgatccggcagaagttttccgttctggcagtcagataagaaatgaccgccggatgaacagcttgttcataggcataggccttccacacctcaaaatccggttccacatgaatgagcttgattcggtccagggtcaccacatcaaaatcccgtaccgacttgttatattccggcgggtttccggccgtaacaatgatccagccatcaggaatcctgtggttgccaaaggtcttatattggagaaactggagcatggtgggcgctagggtttcggaaacacagttaatctcatcgataaaaaggattccttccttaaggccggtagtctcgatcttattgtaaatggtggccacgatctcactcatggtgtattccgtcacgcggtaaatatttcctccaaattccttttcgtttataaagggaaggccaaccgcactctggcgggtatggtgggtaattgtataagccaccagcccgatcccgcactctctggcaatctgctccatgatctgagtcttacccactcccggaggtcccatgaggaacaccggtctttgatggactgccggtatctcataggcgccgtatacatcctttagcagataggcttctatggtattcttaatttcttcttttgctcgtttaatattcatgttaaaatctcctgtcatgtaacttccagatcttctgatttaaggatcaccttcatggcccagcccggtacggaaatatcctcatactgatcctccacaaaaacaaaggccgtatcatagggcggcatcttcaccggatagatccccttaccgtcggtaaaatacaaaagacccctaagcttcccaaaagcgcctttgctcaaaaggccgttcacatattcgaatgcagggcggaaatccgtccctccaaacccggataatgtgaaatgctccatatagtcttccatttcctctctgcttgtgatcgtcacatcagagcggatttcctcgtcgcactggatgatatggatattgatcttccggaaatagctttccgattccccgagaacaccataggtttcctgaaggaaattccgtaccagttcccctgacacggacattgaggtatcaatcacgatcacaaaatcctcaatcctataaacctcttttgtttccagaggttcaataagaggcacattccggtaaagagaaaggccgtaagtataaaacacaggatcaaaggagtctgggtcgatctcagtctcttcccttaatactgcgaacttccttaaaaactgcttgtaatcatatttttcccggttttctatccttacctgttccagaagatttcttgacgaatcctcattcttttccccaaaagactccatttccgtctgcattttttccctgatattctgccatttgttctggcgttccacttgaaaccggggattttcttccgtttcccaccggtcatgattgtccacataaaattctgctgccatccgttcatactgttccctggtcagcttcatatcctgaaggtctttgtaaatcccctcagcagtaaatacctttcgcttttccgccagtctcccatacacctctctgcggtaaggagtctgatgacggtatacaggtttaacataaaaactgtccaaaatggattctatggtgatgtcacatgccagatcccaatattccttttcccgtccccctcttccgcccaaatggcagaacaggcagtggaaaagcatatgaagataagccctgttcatcaggatacggcttcttttgtatatggaaaacaaatgctccggctgataatagatcacaaatccgtctgtccccaccccccggcccgtccagtcagcttcaaacccaaggctgcttagggccacatctaagtaccggaagcttaaataaagctcattgcgggcattggagaggatctcatggcccagttccacctctgccagttcatcaagctgcctttgtctcaccggatcgatcatgtttccaccctctttctgttttatctgtgcaaggaaattcattcgcttttgtctcacaaaacagctgatttagtcaagcggattttcgcaatccgcttcgccacttgctcactgcgtccccgatagtgcgggggaggccctgccccgcttcatcgggcataaccgaatagcagctttcgctgcctgtcaggtggagcttgtactccacctgacacaggcaagtccccacccaccacttaatgcttttcgcatttgaagtggggacttacttgattcggttaaattcaaaccctatgaatttactttcattcagttacttatgtcagggaaaacctcctcttcccagctgtaaaacgctggcggcggagcttcataagaacgcttaatacctcaggcctgtccccgtttcccgccatatccaccattccgtcaaaatcctcctgattgtgaccgtactctaaggcaagccaaaggaaaagggccgggtccttttcctcaagcgccagccttgccgcccccttaaaatgcttcgttaagtaggcctcgtacacctccttgtctttttcaagaagattcacaggagtataaagccttccaagaaccagagcagctgtcacccgctccggctcctgcaccaggatatgaggaaacagggcatcgtatttatggaactgaaactctgtccggtcaaaacagtaacggtacatatggccgcagccatgcatttcccggagaatgatccttgctggtgtatgttccacagactcctcatacatttcaggaaaaaccagccttgcctcccctttgatgctgaaatagtttacataaagttcctgccgcaattccgccagcagctccttcatacaggagcgctctccatcaatgatatgaatatccaaaaaacgaactccagagcagccggtaaacaatccggagcccacatcaaaaatggaactgaagcactccacatggcctaactcataacaattatagaatgcatagtttcctatttttctaatcgtatgcggcagatatatatccttaagtccctcgcagcttatttccggcggaatatccttttcttctatttcaattggattgccctcttcatcacacaggcatatctcttttcccgccgatgcaagcacctctctcttcccccagccatcggaaaatgcataggcagccagctctgtcaccggcagaccccttattttctccggaatccgtatggaaccgtcataccccctgcagcccaggatctgtacatgatcatccgtaatctgatataaaaacatcctgaaatcctctccactaaccgtttaacaaatcaatataacagaaaaatgggagaaatgcaacgggttttatttttaaatatttataagtcccgtaaatctgtacttttccgcttattttcgagattcttgtaacttttaacctcaccaacaacgaccatttgataacagtcaaaatcaggggtcatgcagtcaaaatgcagtcagaaaatgatataattctaccatgcaaaaaggcgggtccagaatgtaccggatacccgcctatttcattggctaactatcccaacctcccaaaccagtatattgcataagattattgtaatacattattatctacactacgatgttatgaacatgtaagattagcatataatagtatcaataagatcatttgagggaatccatgatcatacacgttgtccaacccggtgaaaccataaattcaatatcagattattacaagatccctgttgacagattaatattggaaaacggaattataaaccctggcaatttagcaactggccaaactattgtgattgttcagccggaaacactctatactgtccaggctggtgacactttggaaagtattgcagagcagcatggtactacgccaatggaattattgagaaataacccctatctttccgatagagaacttatgtacgccggtgaaaccattgttattaattatcaaacgaataaatcaggaacaattaccactagtggttatactttttcatatatagataaatctattttaataaaaacgcttccctttttaacatatctgacgatattcaattatagggccacaagtgagggagaagttatctctattgctgacgactctgatgtaattcagttggctaaaacctatggtgttgtgcccatgatgtttgtttctacaattacggaagaaggaacaattattcgtgaagtaactcagaatattttaaataacccctctgtgcaagatcgcctcattgacaatattcttcaaataataaaaacaaagggttatcacggagtaaatatgtatatcgaagatatcacaccggataacataaatagtattgtggaatatgtaaaaaaggcttcagccatatttcattcagaaggttatagagttatagtcaccacaacgccaattataaacattcagggtcccattgtcatctttgaaaagttggattattcacaattgtctggatatgtagatggaattctatttgcatcatatgattgggccagattttatagttatccaagctcaattttcccagttaatgttttaagagaactaatagactacgtaaccagtattattccatccgaattattattcttaggtatcaccacactcggctatgattggacgctaccctatgttccgggcgcaacagaagcaactgctatagaaaacaataatgcaatacagattgcagcagatagtggcataccaatacaatttaacgaagcagcacagtcaccttttttctattatatggatagtgacgggattcttcacttagtgtggtttaatgatgcgagaagttttgaggcaagagtcgggctggtagcagaatatgatcttcgaggtttatctctctggactattatgagatttgatacccaaatgtggtttattattaatacgcaatattacattcagaagtttcccttttaatgctagaagggctaaaacatctatgttattggcagattgtcaaagtatctttataggcgggcccggaataccggatacccgcccttcataacgtttttattaagttcttctttacaatacttaaagactttactgcatcgcgtaaccttacgaaatgcatctaatactttgaatatcagaaaagctgatttcgtcttccttccagccaaaaactaaatcccaaacttggccagtaacagatttatcagtactgctcctaggaatcatccaaaagccacctccactatttagccgaatgaaaaccatgttattcatgcaatcttcaacaactccagcgatcgtgtttacggatgcgggaaaaggatttgagagctcaatttcttctgattctggacttgtagggttggtccccatatcttgatctgccccagaactttcctgttgcacccaatattttttttgattccctcttctacttcgatctatattaatatcatcataaccgtattgcatattattaattccttgataattcttattatacttatatgctttgatagattggacaaatacctgtctattagaaaaatttaatccccggccttacaccagtccctgccaccgtaatgcccactctgattggatcaccggctttaaaattttcctggcccctgcacaccatcccgatctgatacatacagcgcacattccaacgggtgtccggctcttggctcaaaatagaaatcttggcaatcaatcacctgccaatcggtgaccgcgtacccgtccgggttgaaataatacttatggccattgatgatctgccagcaggatttataataggtagtcttcgagtcagcataccaccagccattcttgtcgtgattccagcccattgtatattccggttgctctaccagggaccagtcagggcgtccgtatccgtcaattctgctattggtaagagcatattccttctggcagactgccccgccattggcaattacttccgatccgctgctggtgtttccttcaatagtatagacctttgagctcgttactttatagactattccagtgtggtagatcctggtatcgttccggaagaatatctgatcaccagggagtggatctgatttataatatcgtcctttatttttataatactgcgcgctggtgggagtgtaagcactgaatccaccacacagcagctgcttagctggtccatccccaaatccctggacgaaacaccaatctacgaacatatcacaccatggttgcgcctgaagggagggatatagatcacgggcatacttggtataattattatccccggcattgccagtcttgctgtcaagctgactattcgactttttttcaagatatccaacctctgcttgtgccgtttgaagtagattctcaactgcgctcataaaaatcaccttatcctttcaatagaaaaaggcccaggattacccgagcccgaaaagttgtgatgttacaacttcgttgcgatatcgcaacagattattcagtaacctctgatttctttttcaatacgtcaatggctttcacaagaatggcaggaagcggcaagcccataagcccggcgttctccacgatagatataagctcatttgccatgaatccaataatcaccgcgtcccttatgtatgtggttccaatcgccagatccagccggtgagcgaccaaaacaaacagaagcgtcatgcacttgcggcatagccctttaaagccggcttttgattccagggctccggtttctgttttggtgctccttttaaacactccggccacggccagtccagaaagaaaatcaatgaccataaaaaggaccagggtaccgatcccggtatcccagcccccaaataatgatactataaagcttcccacagctcctgcggctgtacataaaatatttttcattctcattttcctcactctttcttatattcttcccctgtgatctcctggtattcctccactgtaatccagcggcctacagcattccacaccattccctctgtccacagatctgcatcataaaaaccctttactttttcaaaattcttactcatattagactccttccatatcaatatcggacatcatggacagatacgctacctgagcattcagagcctgtacctcctgttccgctgtaataacgggcttcacctctgtttcattcccatcattgcctacatgataaaaggccccatcatggtacttatcacctattccgcagggatattgcaggcagtcaatcgcgaatgcattatttccataagatgctctcgccagccaattggccatttcataattatcgcatacgataacattttttatttctccttcgcatatctgtgcgaatacttgatgtgcaaccatatattattcctccttctaatatccccatcttacaatgcatattcctgatccaccggcttttcctgcattactggcatccgtaccgtgttgagcgccaccaccgccaccaccacctgtgtttgcagttccagctacagcccaaccatcatatacatctcctccagcacctccaccaccggaaccgccagatccgttagttacataagcgccaccgcctccgccccccgcataaagagtgttagatgattcaccaaaagctctcgtagtggttccttgtcctgcgccaccaccgccttcagatcctccagagccattgccgccgttagaaccaccattacccccccaatcatatccagcagcaccaccaccggaaccaccattccctccccaataaagggaaccgcccttaccaccttcagcggctgccacggaaccaaaagatgtagtacctccatctactgccggacttccacctgcaccaatagtcactgcaaaggattgacccggagttactgcatatttaagtacagtttttgtgtatccaccaccaccgccgccgccaggagcactaccaacacctgattttccaccgccaccaccaccaactacaaatatatcaatagacctcacaccagttggaacagtaaatgtcccagatgatgtaaacgtttgttgtcctcttgatgtagtagcggcaactgcatttagtgtatttccccacatatctgcaggggatccggacgcataagctgtagcgctaaaataataagtagttcccattgatggcatggtaacaagggcttgtgaccaaccaccgggtgttgtgttatttccagcccctgtataaattctagttcctccagttcctgggtatccattagtagagtagttaataaataccccgctaaaaggttttccggtagccgcatacgggttttgccattgtaataaaatttgcgttgtactgtatgcggcagcactaaaagacagtatactgtttactgagagagtcccagtaatcttatttccatttacataagcagtatatccgtttaaaagccgcggtgctgttgccgttgcgctggtctggctcgcaaggctgtttgcggccaccgttccggaaccattgtggtagcctgcaggaatcgtatagcttgcacctgcgttaagagcctgactgactgctcccctgtttggcatggttcccgttaatggttccccgtccttatccactataacctttccagccagcacatcaccggccccggcggttattacatccagatcagccccgccaccgcctcccggcatccatatctttcccatgctttacactcccttcaagccgattttaatatccgtaaccggctttttataaactttaaacgtggccgttccatttcccagggaagctgtcccgcttgtcacaataccaaatgccttgctatacaccttctggacggcctctgtagctccatctgccagagcactcacaaccatagcctctatgtctgccgtggcccctgagaccgttacagtctgcgtataaggagctgcactcccggtccagcctgccacggtcaaggtgacctctgttacgtgatcaagacggttgatggctttattcgtagtgttaatgtcatttgccccgaacttatccccttgctgagtataggcagttgcatcaggcaggctgtaggtcccgtcttcgtttggaatcaggcggtaacggcgctggccgtcatacatggcgtccttataatctgtctttaatcccatctaaaaagcacctccattcaatgtgatttctaatgttttccggccatttattctactttggacattactgtagatcagccggcaggcctcctcgatccgattcagttctttccagtcaatgaaaggctggttatcataaaaggtctggcggcttcccaccgggaaagggaaagtcccggaacagatgtggtccacgttggactcaaaccggttgatttcatccgcatggaagccgtaatcctgataggtcttatctgatcccatttcctcaaacgtaaaatccggccagaggataagtgcctgtgaccggatctcatttaagtttccctttatacggttgtaatcttctatattaaagtaatcagtttctttccagttagtttttggttgctgccacatgactcatatccctccttgccttgattgtccctgacagagctccattaaatttcaaagtatgctcatatacccggaggagcagatccggaacgtatttgttctccatgaacgtaatatcatttgcatcgatccggggctctccacggtactgcaaatcatactcccggtccgctttcatgtaatcaccgatccagttggacagatctaccgcatggatcagatcggataccaggggattctcccaggtctccaggctccccgttgggttaagctgccggcttactttagtctggctcgtaagatattcacggcctgatatagaaacttcaacggccccggtaccccctgtgatctccacagtagcaaagtagttactgctctccactatggcggccacctgcccttcctgtggctctgtcaaagcacaggataaatcatagacaggattgttaaaataaaaggtataccggttatccgcagccgtgacggtaattgtttcctttgccagctccttcacctcgtttgactgcttgtaaagcgttcggattacctgcaactctctcacttttgccagctgtgtcccctttggggtcttggtcagctcatggccatactcaaaaacataatcggtgctgtcgccaaaggtgatattatttaggactacccgattattcggatgcccctttgtaaactccagaaccagcttgtcaaactcctcaaattcatggctgatgaccgttgttgcggtcaggccggttactatgtaatcctccaccagctcaccgtcccggaaggcatggaagatcatctcagcgggattattgttcccaaactccaacgtcaggccaaagcatttgaaagaagcttccagggtaatttccaccgttggattgactgaaaagaacccatcactacctgccacttcttctgaggtatatccggtatttaagtatgacgggttcacatactcccctatcggtatccactcataattacttggatcagcaagccagtctgagggggaaagcttatattctgagccgggtacatcacttaaaatggctgatataggagtgactgttgtcgttggtaaaatatagtccgccctaaaatccaatcgattaaaaagcaaaagttgttcagaagtccattgtgcgccccaggtattctcgaccgttttagatgaaatagaagcccaaggactaaaagttgaaaagtcattggcacattgtacgcgtattctggaatttgatggattttcttcggtaatggcgattgaatatttaacattaaaataatacaatcgatctgcaattatattggttttatttaccaaccatcttgtggccccttgattattgacgttttgtcccataaatggcgcgaaagctggatttgtggttttgctcaataaattctcatgctcccatatctccctcggcatatacccgacacccacatactggctattcgcttgcctttcctcggtcatgttgaagcaatctggattaggagaataacggagagtttgtttctttggcagaaaatactgagtaggctttacatccgtataatcctggggcgccagagcataggccttcttagcagtgttatccaggactgcccctgcgctgctaaaataggtctcgttatcagatccggccaccatatccgggataaagctggactttaaaaagataatcccttcccggtcctggtagaggatacacctcccggcattggcaatcagctgcagagcctccttgtgagaaataaccggtacagggttatttactcgcacagactttaaataaggatcgatccagtaggtccgatagtccactccagcatcagaaaacacatcaactgccagatcgtacaggctgatcccttctggccggtacaggcccttataataggttccgtccatgccgtcaaaccggtccgttgctgaaaattccatctgctcatcatcggcggaccattcctttaactgaacggttgcaccaggaagccattccacggatccgtcatcaagttcctggccgtataaaacggtaatgccctgaccgatctccagaaagtttacggagctttccgcattctcaatgtcaaaggtccggtccttgttatttactgtcaggttaaaatcaatggtcggcagctcctccatgatcgggctgatgtgttctttcttcgtggcagagaggatctttctgttatcaaagtaaatgccgatccccattgtgatcttgtggatccggaaccggctttgaccgtttaccatggtcgaaggggtgaagcgcaggaacgtggcgccgttaaatatctcttccgtgacaaagtggccaccagtgttcccggtgatctccaccatgttgttatctgattcgatagtgaagtccaccgggtaggccttgccaaattcaatagtaaggcccttaatatcgtattcaattggaaaccgtatctctatggggccaagaagctcctctgacacaattccttgattcaggactacatctgcccttcccctgggaaggaaatacatactgccgtccaccgctgtgtagtcctggtcacaagtggcataaagctcctggacctcataattgtccaagggcattttaaagctgctgtaatacgtataattttctttgtccggaatgtaggcgctggcctgggcttcctggtttatcaggcctatggtgacacggatatatgaaaacggattcttatactccctcctcatcaaatctttatatttctgactagctggctgcactattcaatcaccccacagtcaattatatttaccttacagtccatgtaccttgttggaagtccatctgcatcaaattctatgggggttgcggtacggttccccgggtacatgcggattgtcatcatgcggttatgtaccatatctgggagccttgccgtcaccacaaatttatcaaactcctgcagcatggccgcccaagtggcagcgtctaaaaatttccattgcaggttctcaaatttgtattgatctcttcctactctctggcctataaattcccccagggcatttttcccttcacttacattcgttgccaccaccagattccctccaatgtcgggagacggaaactcccggccattgatcgttattactgccacatttaccgcctccttacgttgtttttaatgggtaaccacttctcttatccaaatcggccagtttctttttaatctccctgatatcaatatttacagttaagtccatagcctcaatcagttctatgatcttcctgagcagatccaccataagggacaggtagtgatctgacatgttctcggtcggcgtggacattgcttgatttgccatagcctggaccagctcagctgtgtcagagcttcgcccagaggtaccaaccagagacagcggcggggttgcgttactgacaacggtactcatactggacaccagcggtgctatggcagatctcatcccgctttgtacagcactggcaatacctgccgtgatctgcatgttattggcgaccgcagccttacctccccagcttcccaccatttcgggattgccgttttcatttgccacaaataggctgccggattttgggaaaccaccagttgcatggccttttactccaggaccgctacttacataccccttactgcttcccggcccggaagaatctttttcgtcctcctcctcttctgcatcagccttagctttgctgaatagattcttagccccgctgaccaccttatcccaggcttcccccactgccttcacgacaccatctagccagtttgtgatactcttccacacctcctgcatgccgtcccaaagcttattcattaccgctttaccgatctccagcatttcatcaagtttgaaaacatctttaatcttctgccagatttccccgaaccagtccttgatggcgttccacttttcttcaatggtagactttacactatcccagatttcagatagcttatctctgatcgcagtaaagatttcatcggccttggtcttaatgctgtcccacagatcggagacaaaggtttttataccattccagatagattcccaggtcccttttattgcagcaagaacggtatctatcaccatttttatagtattcatcagagtttcagccagcgtcttcattgcattccagatgttggagaaaaactccttaattccattccaggctctttcccagtctcctgtaaagattcctgcgatgaaatcaattagacctttaagagcatcaagaacgtaagacaaagtttccttgattcctgaccaccatacaccaaaagcagcaatcaacccagatagtgcattttttatcactggtagcatcgtatccatgaaccaggatgcaaatggctttaggtaaatatccaacaaggaggtaaccaattggataattccattcacgaatcccgaaaaaaagcctaccaatatccctatgaccgtactgatagtacctgatacggtattccacatctctaaaaaaccatcaaggaagccctgaaccaggaaaacccctatttcagcaaataccgtagagggtgaatgaataccaaaaattcccttcaccacatcaataataccagagaagatttctttaattttcccccatgcccaatcagcaaaagaagaaataccgttaacaaaaccttccatcaacatctgaccaatggtcgaccagtcagtaccgtttgctatttccctaaagatgttactcagacctttaaatacatcagtaatacctttgatgatatccatgatggttccgccggtccaagatgccagtggttttaaaaggttgttccaaagccattctcctaaaggcatcaatgcgtccagaacactgtttaggaactcaagggccccagtaattgcatcaagggcggcaggaacagcctgctccagtgcccattttccaagcggctccagtatgtttttaaataaccattcaagccctgatcctaatttatcccccaggggctttacagcggcagtaatgcgttcaaacgccttcataaggggaccaaaatcaagagtcttactccattccgatagagactgggtaattctatcgattgatcccaataggccgtcaaacagatccattaggttttggaccactgctgtcccggttccatcaagttcccatgccgtccggaagttatcccggatattcgtaatcacattgttgatattcgtaaatatctcaaggatatgacctatgatggattccccggttccattattccaaacggtgcggaacgattccccaatcgtaagaatcagttccagccaggaatttaaccgatcaaagatgctctgcaaaagagccgtccctctcccgttttcatcccaagcttttttaaatgccccggctatatcacctacaacattaaaaatcagcgatacaaggcgcaagatgttattgcaaaactgctccccggttccatttgtccacacttccagaaaactggatccaatagacttagccaaaccaatgacgtttgtaaaggcataattagcagcgtcaattacattcttaccctcttgatcccaggaatcttttaagggtttgaataactgatttagaacgctttttactttttctgcaacggagccaatcgcatccatctgacttgtatcaatatcaggagtgattatttcaggtgtccctgctccgccaccgtcgtcagcgctgctatcatctttcaggatattaagttcatcaatcccagtacttacgccttgtgcgtcctttgctgctttctttgcgctgtttccataagcccccatagccgatttcgcagccacaaggctctttgtggctgctacgctccctgacagcgtcttaccgaacaataggcttacaaatgctgctacatagccagtgactcgtgccagcgcagccatgagcatatttaaggccggcataatagcctgcagaataggagtaaacgctacattcaggtttgatcggatctgtttcagagaattattaaattgatcattggccttcatggaatccatcaaatgtttacccatggagcggattgcgcttactaccatggggagaatcagccgatagatcattaacgtttttagcagcctctgcattccgttttgtgcactggaagcattgttactactttttcttagggttcttccgaaaagagtaatctgccccgcagctttcagcagcttcattcctccattaccagccgttcgaaataggttaccaagagaactggtcacctttcttgccgctccagtaattccacctccaaggattttaaacaggtccgtgatgcccctttttaagaaattcactccgttcagtgcactgccagtaccgatcagggcgaacatctgattgatctggcccacagatgccatggctcttactttagcagtatcaatactgccagaaatgtcctgcaagcctgccactttaggcgcggcatttgcctggggaatcttaacattggcccccttaaagcttccaatccgctggctttcaaccgccatttcatcaatctttttgttgatggcatcccactgtactcccagattctcaattttaccctgcagattaatgatatttccttctgtttttacaatctgctcctggatcttggatttcttggattcgttaaaggtgcgatcataagagccttttaaatctataagtttttcgtccaggacatcaatctgtttaccaagattattaataactgcttcgatctgatccgcctgatttcccaatatctcagaactgggatcaaccttgattactggtaattttacaggcggtcctctcggctttgcagggctaacatttttaccggacaaagctgcgttgtctacagaagaggcggaaacattaacatcagtaaaccgggaaagagccttttcaatagcagcacttaagcgttctcccaaaccatcaatttcagttccggcttttccaaagcacttgtccagtgctgcattgatcgtgctgctaacgttctgcattgtcacctttatctgattgtccatatcctgaaacatttttttagtgtcaacgcctaccgttgccttttcgagacttcctttcagtccggtgccgatcttctgggcagcatcggatatttgcctcccaatatcggactgcacttctaagtccaagccgattcttcctacgctgtcagtcatcttctcacctacctttcatagaaaaacgggcattctacccgaacgcccgcgcaaataattcctgtatttcttttaccgcttttgctttttccgcttccgtcataccctcagtaggattatggcggcttcgccagctgttcctgatctcatgctgcgctttagaaaactgtttaagtacatctttgtcctcttcgcttcgaatacttacaatctgccccaaaggcgtcttcggcatgatcccggataataacgtgcaaaactctttccaatccatatcctcggcttcgacaaggcggatattgtattgcatagcaaaggaggattctatcagctcccaatcttcaaaaatatcataccaggaactattttcttttctttcctgcctgtctttcctccccggcttcagcctccaccttttccaaatcctcattggcaatcgctgccatgataacattgacaataaggctcagattatccatggttggatcctgagacatgatgtattcgaaggcttcttctcccagggtgatcttgataatatcatcgatcttgtcaaattcatccttttcccgatcctctgtagaagcccgtataaaaagcaccgcgcttttgcttgtattaatcctgtattcgtggtctgcgtcaattttgactgtaggccgttcctttccgctctgtaatcttgcaacaatgtcataagctcttgccatatctatctcctccttattctcctgtctcagtgccgtcccctggtgtataaactggccgcccgtctccgaccatatcgaattccaacggagctacgttggtggaatcaccgccataaattgatttcacatctaatacgcaatcataagccagctttccgccatctggaaattcaaccgtagccttcgtactacaatccaggccatctttccacgcaacacctgccacataatcatttccaggatccccgatattccgctttccttttaagctgaccttgaatttcttggcggtcatcagggatcttgcccagccttttgttgtcataggagtccaatcctggacgcctccatcgatgctgatttcaaaactttccatatcagcaatttcactcatgtcactttctgtactggcttttcctttcgtgccaatcttaaatactaaaccgtaaactggaaatactcctaaacttgacatattatcatcctttcttgtaatagatcacaaaattaattacatattcatagatacctttactgtctgtcccgacactcacaggggagtccgttcgcatatcaaacaaaaacacttctttatcccccacaatcccagattttccatatagatggtcatatagctcttgcgcttttgcttccgcgcaaaccgcatctgctccccaatggaccaggatggatactgccctggtgtcgtaggacttattttttaagccgcctaatgggacaggacggtcaggcccctgtgtgggatatattccgatacactgtttatcatttccattgatttttccaatgtaccagcagggacactctactttggatttcagaaaatcctttacctctgtcagcgtcatgttatcaacccctttgcatttgctttcagccgagccttaaaggcatttttaaagaaatctttcttagcaccatcaatatatacctgaagccacagcccccggcattctggtttttatcagttcgaaagttgtattccgggtgccagtaaagccgccttgcataaggagtatcataaacaagttgatacttggatcttgacttctttttcatgaaagaactgcgctccagctcaccggtctctttaggaaccacctgactgcttacaatatcagatttcacagcagcaaccgcctgttgaatcgatggctcaatcgcctcctggatctctttaagcttaccttgatccagttctaccgtaacattcaccttcattagactagcctcagttctgtaaagttaaccgttccgtccggattcctgacttttagagcctgaataatagtacgatttttagaaaagatcgtagcttctcctccgctgatcacaggcaggtcggtataaatatcgccggggaataaagcgattcccgatatttgcaccaacttctgatctgtatccatgatcatcttagcggaatcctgatagttgcattttaagtccggaagatctgcagccaccaaaggaccgccagtttcagacagtccttcttcataaaggattaatgatatgtctgtcttacagagccgcttcggtaccaaacatggatatttcatagactcacctcgctaaccggcagcacaggcccgtctgggacagctgggcatacacatcacgcttcatagccacgcctttatccatgaacacattccaggagctcccaaactgtgccgacactccattaatgctgtagctggacaggattgtgttgatttcgtccgcattctcaaactcaaagtcagcctgctgacagatcacttcctgaatgacttcctgttgaaattctgacagagaagaaaatccccggcccacaatgcgattgtaggtcagggaatcaatgtgcctgctggcttgccgaaggtgcgtttccaggtcttcttccggtactatgctgcctttataggtttctttgtaatactctggggttacatagggaacgtagggcatattactcacctgctttcgctttttcctttgcaagcttttctttttctgccagctgagcttttaatgcggcgttctcctctttcaaagcaaatacttctttttcatgctctgcgactgtaatcttcttcagaggggaatgctctatcagctccccatcgtcaccataaatatcataccccgtatcaaggtaacgtttcttctctgtttcggtgatcgtgtacaccttattttctttttttgctttcatggttacgcctccctattgatgatgcaagcctgttttaactcctgatccagcgcaaatgtgccattaaatcttctattctgatacatgtaattgtctgcaactctggaatcatgccccggagtgtaaacattgatgtaagagtacttcactctagaaacctgcgcttccggatcaaccaggatataattgatctgctttccggaggcatcagccacatatccctctgtgaagtcataagtagttttgaatcgctccaacggaacggttacaatctccccaggtcatctaagccatgtactctgcggtcaatcttggtgctgccattggcttccagggttcgctgcagcccttccgcattttttaactccttacggtaagctgctgtacagtaaagaatgcatcgggacaacggaatgcctaagtcttcaaacttttcacagttatcatcaaagtctgcaagaatgttggcgcgggtcactgcattggtccgaatctccgccccgactctctcggcttcggaataaatctttgaaaatgtgtaacagtccaactcaggaattgcctgtcgtttctcaaatcttgcctggatattggcaatggacatgatctgatttgtttcgtccacgtccatgggatcaatgaaaaactcaatatctctatcgtggtcaagagatttggtttcaaagttgttagagtaattcccgccgttaaaacctaacgtattccgatcatgatccttataaccgctcactgcaatgcggggaattttgatatcctttgcccctataatcttgatatccggattactgttgtacagtgcgcttgattttaactcatgcccatacatatcaataattctggtgtgaaactgtgtaacataacttaacactgccataataaatttcctcctattttttaactccaaaaattttgtccaattctgcatcaatagccgttgtggttcctccctggccaggggctcccacttgtacaaagccagtagcctgcccggtctggggttttagagcaggcacatcttccagtacttttgttaaagcgtttttcattgtctcatcattgatcttgccgtcctggcctatgacttgagtcaagtcagccatcttaagggcgtatggaactgtttttacatcaatacctaatccgatcgctaccatcgtagccgctttgtcaattgctgcctgctgagcagcagcctgcgcctgtgcaagctgtgtttgcatggcattcacatccggctgagaagctgccttctgctgtttgaatgcggctatagcctgactcatttcttcctggcttagcccctgctgtttgagataccctttcaagacgctatcctcagtagcagcttgtttccctgctatcggctgagcgatcttatcgtaatcaatagcaggagcagcagtctgagttgtctgctgggcagtaccggctggtggtgtctggtttgcacctgtggcagctcctccacctccagatccgttctgtcctccatctgcctcaaacataggtataaatcttccaagtctcatagtttataatctcctttcacagttaaatggtgtctccatgtgctgtttgcacgaacagttgataacagtgtgtctcaccgtagtttatagcgccttcgggcataaaaataagacgcataaccctgcgcctcaaaggaagatatccggatcaccttaccctttcttatccttatcaatggaatctaacagcatctttaaagttaccaaaatggtaatgcaaataatagccgtgatccgcactcctgtagtcatgtaagatctccttcctgttgcgatatcgcaacttttaaatataaaaataccaccggtccttttacagatcagtggtattaaacagtgtttattgtctctatgtctaccgtctcaaattcaatcagccttgcattgcatcgaacaatcaggctttcatttcctgattcattttcatctggaaagcaatagtcttcagcaactccactccagtgctttccggaaacatcgacaatattaacttcttttgaataaaactcttttaaactcatgtcaattctccttccttggcactacatgcgtccctgtttttgaataatggattgttgcctttcttgtttcctgctcttctcccaaaggatccacattaaccccgatcggcttatctgaaacaaccttttctttattattccattcgccgcttggtttaaacacaggttcaccggttccctgcagatcatcgacaagcttttggacctccccgatctcaccgtacaagtaactcctgccttctatgtacttatctgagctctttatgtggcgcccctgtttgtcggcattaattttggtgtttacccttccggaatcaatatatgctcttacaatattacctgatttcattatatcagttttggcggcttttacaacactaacttctggatttttctccgtcagtccacgtgttttttcccgatttggtgtcctccgtatctctgggtgatgttccagatgttctttcatcatcttatgcaactcaaacagtttatcatttgccaattttactgtagccccttgtgctgccccctcagctatccgtttccattttcgtatctttctttcgatcgctcgctgcatctgctctgcttcgtagttttctttggcctttttttcgtctggtacagcaggaagcattgttacacccggaaaatacgttgccagagtatggcggcagttagggtgtagcaggcctgctttcatagcttcagacaaaagaggaacccctaattccttagcctcctccgcggtcccgtggctgaatacatcatcaaccaaaacccttccttgccacggcgcgcacttagaacaggtatttgcgtgagctgatacaaaaacggtatgaactccccattgatcccttaactttccctcagcaagaaacgtcgcccgctgggaggcggtacgcaaagccatttctgcataactggcgatatttacccgcctgcctgttttatactcaatacaattaattccggcatttaagaaatcttttgtagccatatcaattgcctgatctaatgttttcgtgcctgcggccatgaacattccagttttatagatggtcttccggtaaacgtcgtccatgtatctccagacagccccctgtaccttttgcatgtccttagtaactttatccttgaggtcatctaacttttgatcattatctttcccattcagggtcttttctgctccttctggtcggaaggcggcgttatcagtgacctgaggggactggggatcctgatcctcacgattcttttcgggaggtcggaagataatatctgccgtctcctgcatggcgtttactttgccctcattaattccgaaaaagttttcctccggctttgccggtatatccaagtcctttttgtcctccgggattggaattggtaggtttaatgacctgccggcggcactgatcagccgttgtaaggtattctttgccttatcaaagctcccctgcaatgtgctattgaccatatctttgatctcggaactatgctccttaatgatctccagattctcttttcggaacttggagaggttccgaagctttgacttttgccacatctcccaccggaatccttctttttcctcttccttttcgtgccgggtaaggttgcggttgagatttcggatgagatccagctctatttcctcaaagattttccaaaggttgtaagcattgtcactcggtaatttctgtttctggcgcattggctgcaccctccattccatcataaccggctacatcgggttcctccgtttccatgatccccagctcagcttttaaccggctcacctcttcggccttccattcctcatctttactatctccccacatttcctccacctgggcctcaatgctcatgacgggggatcctggccgggcttttgacattgtttccacctggctttcaaaggacggattggcatattcaccaaatggtatttccaccttcacctcttctaaaggctgttttagcaagatttgataggcattgatacatgccgttatgacttccggcagttcttcctgcaaagcctccaccacagcgttacgggtgtagagagtggccttctccttctctctttgggcctctgcattatccagtttctttacatcaatacctagtgtactgggagatatgattccctgcaggcagagatccaaagctgtcacatagctggcgagataactttcatgaggaatgtccggctgttcagtgttaatcatgtttttcccgtcttcgcccatattgtcatcaccggagataaaacggttgtcaaatgggttaggccttatcagctcacccgtttctggatttcttggtatgtaagattccggtataaaggttctggccctaccggcccgcagtgcgtccatccattggctccaggcttcatcaaaagcatcgaaactatccagcttcccatcaaaaatggatccgccccggccttcgtatttcgtgctctcatatatctttagtggcactgcaagtatggtactgctgtcaaactggtaatcagacaggttcttcgtcttatcaatagattttagatccacctgacgatcttccacaaacaactcattccgtatgtatccatagccgtaatgctcatacaagacataacgcttttgtttttctgtgtatggcgttttaaacaccacctcttccaactcatcggcatcatagactaactctacccgttcccctggataccattgaaggataggaaatttacttttctttgtgttgaatgttactttccaagctccatcaccgacatataatacttcttttaagcacccttccagcttctttcgaaaacggttccttttctctatatccttccacaagccagcctgcgcctcgttatcaaagtcaaagtcattcatatctgataatacaatccctgtcaaaacacgaacgattaatccgggcaagccggtatggatctttctcatttccattcccggggtgcacttggatgcccaaaatttatactgatctgcaaactcagcggtctgctggtaaagctgctccagttcatttccatcaccgcggtaccagatccggttgcggatggcgtgaagctcaaaatctaaagtctcatggatctgaatcgtggttcctccacttggctggatatcaagccagctgcggatccccctttttatattgtcacccaatttctttgtccacctcatttcttttcttcctcctcaaatcctatcaaatttcggtatgggatccacccatactggctggcgttgattgtatgatcgttgcggtcctccggttcgtccttatcttcctgccaagaataccggtccagctctcccatgtgctctgtgcaagtatctacaaccagatagcagccctgtgtgatccagcccagcatgaaattgatacgatccaggatcgtcactttcttgtaagaatcgtggaagttatacaggcagcctttgagccgcttatatttcttaagctccgtgattgttgcctgatccgcacaatcaataaacacatcttttgcaagtccccattcttttcggttcctttccaggaaatccaggaacttcaaaaccgtgtccgatggagccagcggaactgatagatcggcattactatacaccttctcatcaaggataatcaccctacggtccgttgtgatggcctggaagatcattgcaatggtatcagggcttttactggaataagaggtatccagggcagccgaaaacttcttgacctttatctttccggattcgatctgctgttttacccaggctttgctgaccacatgctttttacggtcaaaattcgggaaaatcagtccggttgctttccctctcaggccctggatcttgtttttccagatctttgtaccttttggagtatttgatataatccgatccagcttctccttggacaggcccagattatgggtaaaagaaaagaaccagtgcacccagccgggctttggttcttctcttaattcttccagtatttctttcggcgtttcatcctcccattcaggaagtggccgggagcagtttatatactccttatagaccgggagattgggatcatcaggattaagcgtacccatcaggtaatcgcaacgcatggcggactctcttacaaactcaatatccgctgtgttgatctcgtcaatataaagacagccgtactggccgcccagggccttctgccatttcttcttgtccccgtatcccattacatagatgatcttatcgccaccggaagtatggaaaagaatgtgggggatcttatcatctttggttccgttgccgttgtattcagacagaactccaaaatcatctatgattcccagatccttattgatgatattcttctcagcagttccggtatcctttgcagcaatgatgtgcagcttcttagggctctctgccaccttaagcatgaacttaaaaaggccgaccgtagtcttgcccgcagccgtagttaagttccctcaaggaattctacgggagcatcgcattttagaaatgctttgtatttttcagataacaataatctttcagaactcatgaggattaatcacctccctgcatctgcttaatcaggtcatcaagcttcgttttctcagtctccagggtgccagacacttccagtttatccttaaacatgcccaggtgcctgccgatcagttccagggcctttcccttatcattcagtttaatttctatcccgttggcaccttccttaatgccagcaatggctccaagcttatctgggggcatatcttccgtttgtttaacttttacatagggaccttcaattgtcacataatcagtgacatttgcaaaaccgatctttgctaactcctttaaaaccatgtcctgagtgatctcagtacgcttctcccggtctttcattcgtttctggatataatcctcaaccttaacatttcttaacaatctggcccctgcagctgcggccgactcatcattcttgacctttggatatgccagcttgtaagccctggtggcattaagatcaatcaggtattcatctgcaaatattttctgtttggctgttaatgccatcaggttcacctcaccttccaatctggctgttttttacattaaaaaagagacggggttgagccgcctctgtgttctttctcaacatgtacactcaaatataactttctctaacaaggacttcaacttcgcatatgtgaatcaattcttctggtataccagactgccttaagcaatcatgaaacgtttctaccacttcctcatctgctaaagcaactacattttgaaggtttgtgatacatgattcattaatatcgccacaagagttaacagcttcctctattattccacttgcaacatatgcaacttcattagcacactgcaagactattaattcattttccccatcaacatcaggaatagtgaaattcacaatcgcttcatacaacttggttccttctggctcgttataatttagcctccatatcttaatttcaaagcttgacatgatagtctcctacattaaatctataattcaatatatgagttatttgctaagatgtagataaaagaaaacacccatcgaccaaatttcgacaggcgttttcataaaggagaaaatcaggaatcaatcagctgccaagctgttacacccggcggccgcagggggaggttttcctaatggattcatctgtttacagatttctcagtttaaataatatcactaaaaaaccgccgtaaccgccgttttcaatctttttccaaaaatctatcatgcttctgccggcagctactatccgtatagcaccgcatcttcccctatagatctgatctttatacaaatcattcattctatgcgccacctgcacccagtttaagccttccacataatacagtgtcatgatgttcctgatctccatcttatcaaccccggctatgtatttctccacctgattgatcagctccagaagttcctgctcctcgtccatcaggatagcgtagctcttttcataggccctggcagctttctgggattcaggaactggatacccaatgatcaccgctgttcccagaggcttcttgcctctcttccccttggtcacggtatccgccactacatacccccgttcccttagcctgtccagatgatcctccttcttctgcagctgctcccgaagaagcttcacccgggccagcgcatcggaatattcaatcaaaatgtctttatctatttcagtcacctccctgctgtcaatatcctttctgttacctcgtcccattcctcagcccacttcatagccgccgcagtcttttcattcgccagtcccacctccttgaaggtgtaccggtctttatagatcaggccgtcccttgcataattacaaataacacccggggccgtccccaacttctccgcaagctccttggctatccccgtatctattggcgcgccatagctacaaagggcatatatctttttaggtttcaagctgcaccttctttcgctttggtggcttccgtaacgccggatccggacaaaggcttgtatatgtataagccggatgtgttgcagagaaggtcttggcaggaggcgccttcatagcaatggctgcctctaccgtggttatcctctgcgcttggacgtattgtatccggcgttcttttggtgattttctcaatccaccatccctttcttcattttcttataccaatttcccgataccaggaatatggttaatcatgcaaattctaactttactatttaatttattttcatgcttttgtataatcaatatgtgagaataattcactgaaaggagcttttatgtttaaaaaaggttttcatattgatttagaagagtcgttaacatatccatctgcaaaagtaatgtgttcatgcatagaaaagtatgcaaaatcaactggagagaaactagtttttataaatacacaaaagcctataacttttcaccttaatgatataccttatattgctgaagtttctatgattcgtggcgggtactatattcattgcaaggagaattagtggtattactattcattcaacggaattattctcacaaataaattctaattcgtaaacaatcttaatgaatggcctgctatctttttaaaatttgttataatataattgtattaaagaaaatttcaggaggcctcccatgttcagtattttaacttttattgttccaatacttgaaatatttaagtatgttgtttacgttatggtttttctgtgctgtatcaagtatctaaaggaataatatcctttctccctccggcccctgcactgccagtcaggccggaatgttatgtaatgccggatcgtattaccctctacaaattttaaacgcatcttccaaacttctcaccctaagtggcgtacccatcatgaagaaaccgcctatttctgttacctctttacctgtaaagtatgctataaactggtcgggccaatctgcatcataaattttccgcactccttcggcatctgcatataaaaacctgataaatggtattttttctatttgctgatccatagtacttacctcctgctttgctccgtcaaattctatttttccaggatcatctgctccgccggttcaatccccacaatacgctccgccaatccctttgccacttcccatggagccattggtttgtccatttcataaaaataaccatggatcgaaaccaccaacgcattgtaccaatcacccttcttcatgaattcagctctgaccacttccgcagctgcctgaagctgatcggttgcgttgtatgtatttaggatattgcataaaaattgacccatctcacaaccgccgcagatatcgtccagttcctcccgatcgctgatctccctgggaaaccggcataggtgatcacatacatgctctaccatgggagtaatgatctttaccatttcattctgttctgccatactatctcctctttgcctccgctatcgcgcttatcaactctgcaatacaggcccctgccctggtacaatctgcatcttggtatctaagtccttttctattcattatcagattaacctttcgatcaaccagcattaaattttccatatctgaattaagagtatttccgtccaaaaatataactacctttcctcttggcatctcaccataatttttctcccactccacaatatgcttcggtctccacttattcggttcagctactttcacataagcatatttatttccgttactggaactgcgccttatttgttccgatcccaggggcttgcttacgtgggggcggcagattatccttttcaaataggattcttttcggcctgtttggatttttcgccggactaagaaataatgtatttgctcagaatctactggagggttgaacctttcgttgaaagcttctgcaatctccttgtatccgtgaccgtaagcaaacgatgtaataaactctacttcagtttcagtatatcttctcgctgccactattccgcctccaggaatttaggaaccttagcttccttcaagggtcctatctcactcttaaactgttctgctctaagcgccagggctccattggcaatgatttgagaagctactcccgtgatagcccttgcccgctcaatctcctgcatcagggtctctcccttcagttcctcgtctccaagtcgttctatctctgcaaataaatgattgttcaaatcaatcagtttattgttcatgaccactcctcctatttctttttctgaaattccttcaaatattccaccaaagctgacatattgctgctacactcataaaaggtcctggtatcatcttctatacaaacacttttattgggactccattctgacttcacacccaggagataatactgcttagcaccatattcacagtctttggtttctttaccacttttccaggtatgtttcaggcttaccttcacaaccatggcgatcttgtccgataagtcatatctgtaataccgctccccggtttctttctggtcaacccagatcggccatgtggtatagttttcaataaactccttacgctgatcattgtttttcaggctgggaagttctggctgttcctgcttagctggttccggtgcttccatatcctctaccatagtggtcaacgcagcaacaattattttctgacgctcaaccattggcggcatctctagtccttcgtcctgatatacctttacccagttgtgaagttcggctttttcttcttcaagaatagatcgggcagacaattcctgttctggtggaacttccacatattccccgtcgattacggtttcccggggctctggaacgggttctggctcttctgggacagattcgtgttttggtgtgacaatttccggcttttccgggacaggctccggttcctcagaatccggatataaggctgcaagctcctgcacaaagcggccgtattttaggtggaaatccaccttgccgatgtggaagtctatgccggcggtaaaactgctgaaatggaagcggtttccatcgcaagcttgcccagaatatcctgctggggcaaggaacatctgtactgcttttgcccggtcggaattgtttttctgttccctgcatactcttaagacactgtttcgtcttttcgggtactgctcggcccagaattttgtagcccaggctgcgtcatatttggggatctctccattacggccggcggaagcattgcattccagctcacagcggccctggtatctgcatatccagcaacaggaggatccgcagttgcttccatctcctgggacctctctattttcggccaggactgtacaactgtatccgtcccgatgtgggcagctggtgggggtagagttaaaggtaccttttccctggctcttctccgcccgcttttccgtcatctgatctatgtatgcatcaatttgtttcctggcaaagtttgaaaacttcttaaaaagacagatgcccaggtcttcatcgcttctgtaaaactcaataatttctgcacacactgccgcttccacgtcatcatcaatcactatgcttccctcgcgtgcctgaaacagtttcagcatgtcaatgatgctctcatcagtgattctaataaattcaccgttcccaaacaaccgccttgcattctcctgaacaaacagctgggctaacatgttcacatgtctgtcggaagccctgggaaagtctgccatactgtaggattcatctactttcttttcatcatccggattataaaatcccagttgcggcagatcctcctgctcttcttctggctccttggattcaagttccgccttatttccgaaaaagaaattatattcccgttccagccttgtgttttcaacgtcaaacgtaacagccgcggggcgatcgtctcctgaacaattataaaacactgtaacagtctcacccttgacagctctgtactcatctccatagaccgcaattttatattctctttctggtcctttatatccgattcttagatactcctttaccacctctgaacggatccagccataagcatcacctgtggacttgctctggtcaaaaaagtgcctaatctctggctctgaatcctgatcctcctccggctcagaagttgtgacgtcacaacttttttccagctcctcagtttcctccggcttcctgatctgcttcagcttcttgaccgtcatgcccggatcaacttcctcccgctgttcttctgacatgtaggccagctccaccagctgataagtgctatattcaagatattgcttactgagaataggggaattcccttcctcagacagctgctgatttaccttaatgcacttggacgcccagcctttatccttgttatattttccgcggacataatcttcaaaattctgatacccggcctcctcaaacagtttgtcatcccgtatcctccgaagataatacccgtttgctacataggccctggctgccgtgatcagaccactctgtatgtattgctctgcctcctccaaagtcatagaggaattataatatctcacttcatccatagcagcacctccctgctctttatgttttactttcctttcctggcatacactcaaaatgtatatgcagcttactctttctcttggtttgtatgtacacatgctccccttggatctccttgccgcagatatggcagagataagtcttttcctgttggggggcgcttgcttttcttttagccggcatcctcaatcctccttcaaggtttcaaattgttcaggtgtccagtgatcccctcttaagcagtttcgacattcatctgcttcctggtggcattcaattccatcgtaaaatttacactcagcacaagttccagcgcatttattaccacatgtatcacatacgatctcataattactcattcttgattacacaccctttcgcaatccggtgaacgatctctcgcagctgtccagcatgttcaagcacctgatccgcatcctgttggcggaacactgcatgactcaccttttccatgatcccggattccttaatcgccgtattgatctccatgtatttccccttcgcctggatccgctcaatcttcagaccactaagcactatgtcctgaaggatttgtattgtcatggatccaagcttttcctttagctgctcatagggaactctatactttgttgtaagaagatccagtgaaacattttctttattccgcttcaattgcttaagcagggatttatactcattcaggtccacctctgtcagctcaacagaattaaatggtttctcttcgtaagcctggaatgacatttcgcacatttttataaacctgtccacctgctctttactctcaaatttaggataatgtccgggaaccattctgatattgctctccagaatgcgcttttccgcatattttctcacttctttcgtcataacatcacctcagtaaccggattttaggttacagtaaccctgttttctatttgcataggttaccgctcaaacccgcacagaataaaggttttctggctacggtaacccagtaacccacttttttaggtttccttacgcgcgagacatttttataaaaccttgttaaataatctacaaaagttttgaaattatttttttgtatataggagtgtgtttttctgggttactgggttactcacccctaaaaacaccctcaagcccgcataaaacctagctttttgcggtaacccctcttgggttactcttaattgaacggaagctcttcctgaatactttccgcatcatctattctcacaaagccgtccttatccgcatcgtcattcagcttaaggaatacgcagcgcaccttatttcccttaaagctctttatcttatccatcttttttccactactttccgcctggatcagccccttgcgattcgcccaagacagaaaggaagtccttgaaaatcctccgtctttacatagcgcagtaaatgcagtggtataaataatggcatagccattttctatcacgccccacttctccacattttcattttggacatcaaaccgagctggattcatggcaatcttatccagaataaactgatagcagcgttcattgtcggaaagctcgtttcgatccaccagaacttccctagcctcttccaggcttatgtattgtccatctttaaacaaataatctgtgaccagcttatccgccgtcaggacgattgacagagacaggctctgcttctgcatcttctcgtcatcggccagaagctttgcaaattcctgctggatctccctgatcttctcaattcccaactcttttataatctcaataaactccctgcctgcatgaccgtaatttcgcttaacaagctctgctgtatagccagggctttcaaaaacacgttccccgcactctatttcaagaatacggttaatggctccgccctgggtcacataagagcttaaaggcctctctccgtttgtaaggatgcagttcttccaatgattctcccggtttagccccagctccttgttagagcgggtttttccctttccggaacacagatcatataccaatccctcaaagttatcttcaattttccggttctttttgctggaatcgtccaggacaagtggaaggttatttaacaggtcgcagatggcctccaagccaacctccgtgcctttatagtcctttatgtaggcgctctcatcaggatcggcccagaccgacgcagccaccattagggatactgttttaccgccttctgtctctccccagagatcaacaaaatacgggaggcccccaagcggctgaaccaatacactggaaaacgccgcagccagcatgaatttaacttctattcttccggccttacgcagggctgacacatgatcaaaccactttgtccggcttccatcctgtccgatgctctcatatatttgccggaagcgcgcgtccccatcaaagacaatttccgtatcataggggaggaatccgccccggatccagcccagcttcgatgtggaatactgcactgtgatgtgctcctcattggcattttccacatcagccagatatctcaccagatactttgcgttctcactggtaacggcgatcccgcgacccgatagagaaacgatcttattggccgatgtgaccatggtcttaggaacaatgatttcatcccaccggccgttccgtttataagccagtttgatctgctcctcgcccgtctccaggttcttcaggcgttcgatcgggaggatcgggtgataacaggccaggatatccgtatagcctgttgatggatttctgaggcagatcccgctttccgtagcgagccattccttgcattgcatattttcatagggacctgtgaaattcgtccagttgtccagatagcagggagttttactcttctccctctcttggcgcttcatttccttttcaacctttttataggccgccaccatgtccctgaattctgtttttacttttaattccgtagctcttaagccaagggaagcaagaagctccgctcgatacagctcatcttcctggtcaaaaacttctgttaaaattgtactggataatattgtttctgccgtgagctcattcaacggcaccatgctaccacctcgcttctatttcatttaattctgcctgtacatagagctgatattgcaaggcattgtaactatcacaccagacgtcactgaaaggctctgaatggtctatatatgcccggaaaatacctataagcatacagttaagccatttctttctgccaagcctctcccgttctttttgcagcatactccggtgtttctgggaccggtaaacagtaagtttggaagagaatgtcggcttttcataagcacctcccagggcctgaaaagcctccttaaaggaaatattttccatcagctggacaaaagaaaaaatgtctccgttggctccacaggcatggcagtggaagtcccggtcatacacctttagagaagcctgcctgtcgcccgaatgaaagggacatgaaatgaatcctctgtggtttggttgaaaaccgtaccgggccacaatgtccctcatactgtatttctccttaatctcttccaccgtcacccggaacacctcccagcagctttatgatccgttttcctgtctctatcctgtcgcaaaactcaaaccggcactgatattttctctgtaaggtgcaaaggatcttatacagcttttccccggtgattgccttggttgtgatatctttccattttcctgtatccggatcctgtatccgcttatggcgccggggattatcccaccagatcacatcctctaggcgctccatgcccttcccatgctcacacaagataatcacatcgataccggcttcatttgcacggatcagctcattccggaagcggtcatgatcctgacagacgttattgcagagctccgtcagattctgtttccggtcgatgatcagcctgggattgtccaggttcatgtaatccccgacatacagcttagatacatagtaatccactctctggcagtcaaactctgccaggatcttcttaattgctttggccttctcccggctgtctatctgtatattcaatcaatatcaccgcctaattaaagggaagtccttcatcccccacgtcatcaggaatatgcatgaaaccatctcctgcgctggaaggctccggcctggagtctccttgactgctctcagaagatcccttactctccacaaattccacattgtccgtgcagacatctgttgtataaattttctgcccatcctgattcgtataggatccggtctgaatgcgcccgatcaggccgatgcgcatacctttccggaagtgcttttcaataaattctgcggtcttgctaaaagcaacacaggaaataaaatctgcttcttgctgtccctctttacggaagcgccggtctactgcaagagtaaaccgggcaaccgttgtgccgccgtctgaataccgtacttccggatccctggtgaatcttcccacaagctgcacattattcatgctttatatcctccttctcgtaaagcttcagtttgttcatacagtccttgtaattctccaaagtcatttcttcaatctttttaatcttgtacatggccaggatcttgtccatcttcagccccttatcactgtatttttcaatcaatgacttgacagaagtaatcatcggatctgtaactttatccgatgtctttgctccgttcggaatagactctgcagcgggaggattggctggaccttttccctgtcccgcattctttccagaaccacctgtattggaagaagaactccttccttttccggaagttttgttgttttctgctttgccctcatctgtcccgccctggtgatccgcatccttcacatcgtcaatgcagaacaggccattcagcgcatattttctggcatagctgctggtactccctgtaatctgggaagcgtccattcccttcttgtccagctcttcacgggcgaaagctgtattcttgatctcatcaccggattcgcagtccacaaaccgggctgtggcttttatgtaaaaccgctctcccatctgaaccagttcgtctcctacgatcagaacagccttcacctctccaagaagcggctttgccgcctcttggatatcttcgcaattccggtaataatatttaccaaatatgttgtactggctcttgggtgctttaaggccagcttgtacttgcaggagtttttcctggatattcatgcaaacacctccttatacatcctttctttcaaagtaaagcccaagactgttcatggccatttcaagctctgccagctcacactccgtcccaagcactgtataaactgctgtacgggattctggagctgtcagaggggccgcggcaactgtatctacggaagtaattttcgctttcgtgttttcctcggtttccctgcgaatccgctcctcttcggcaaccctctgacgttcctctgacttcacacgctcaatttccgcctgatatctgcgctcctcttctctcttaaggtgctcctcctcccttttgagaatttcagccttctgaatttcataccggtttatatgtcccagagcatccgcaagattaagggtggactgaaactttctcaacgcttctggtacagcttctgactgcatagcctcaatagccgcttttcctgtcctggcattggtaataatctctgtcatttcctttgccagagccttaaggcttgtactggcattggtccacttatccgacttgattttatacagcggaaggaattcaatcatgtctccgatagtttcattatagattctctggatatcggcctcacgctctgcaatacgtttattttcaaactcctcaacttgtctaagtatgtaatcaatagggatatcaagctttgcagacagagccttgaccttatctgcaaacctttcatatggttccatccataacttttttgtagttttaaggctgtcatctacagacttttttgtttttctgagatcggctacagacttcttggcagctgctttctggtcctctgtgaaaacaacaccatcgtactcatgggtacgttcttctatccatttttcaaaatcttcaaagtttgctgtgatctccgcattcaccgttgttactttcagttccatattgttcataatccactcctatctggcttccgcgagccactttcttagtaatcctcgatttattgatacattcctcacacgctgctccatctgaatccagatgcaggccgcacatgtcgcatttatgcctgtccatactttaatcctccaaaaactctgcagcctccatctgggccatctcagttagtacaaaatgatagatttccttgtcctccggatccttctcattgttttcataatcagtcagtttttccctgagaagaacccagagcttacgatacttattcatgtcccacccttttttccggcagctcaaaccccaaaatactggcaatgtcctcctgcgaaatgctgtaatcactttttatagtaaaagatttcaaggcttcaagcctcgctatggcagcttgtccttttgcgtactcattcaaaggaacatataccattattattttttcttccatcttgatttcctccgatagattccctataatagggatgtgaaatatttacgtgttaccttgattccctgggagttgccgctcctggggtttcagtttttagagtctgtatgactccatcaatttctgaaattgctttttcgtactccagtttagaaacctgaaaccgtttgagcaatgcagttctggcccgcttagtcactacaatgtattggccgattccctgctttaccatgattgcctccggaaactctgcttgaacatacggaaataattcatccgcaagtgcttcattagccatgccgtaaggcgatcctttccggttttgcaattccgttaagtaatagttcagacgatcttcatttatcatgacccctctcctcctctcattaaatttcgatttcatcaacgagcatgaaacatttttgtctaaccgctatcatgactaactgtttttgttcatccagccattcaccgaagtcaccagtaaaatcattattttcagtacagatcattgcattgactgtcatgttcataccattgataaaaccaagtgcagcatttccagctgcttttgctctttcaatagtctctgccttatcaatccattccttgtaattttcaagttcccgtcctgcgcttactgtcaagtcaatattgttaatttttttcatatttcaattgctctcctctcacatcacttccaacgagccacataccgcaaacagcacggccagacaacagaaaaatatgattgtcatccggacgtagcatatggctttgtccattagtgggtgcctgctgtgatcggtgtaatcatctaaattgtcatagtactttttcatgagatttaccccttactctcttctgccaattttagcagatactgatcccatttatttacatccacttgccatctacggccaacgcggattgctggagatccttttcttttaaacagggactctattgtgttgtgacttatgccgtggcgctctacgcagtccttgattgttaggaattgcttgtccaactttattttccctcctctcataatctttgcatggataccgcctgctccgttccagacagcggttgcggtaccggcaggacttgcatgaatatgtaatttctatatgtatcaccattcctttcttgtaaaattttccatttctccttataatgtaagtaccagactgccatctggaatatatatgataggagaaaaaaatggttcctctaatcaatgtttcattaaagtttttcctactgcttttttttgttactgcatacattgttaaaattgtaaaatcatttatgaagcttaacgaaatattaaaatgtttaaagtgtctattaagatacataaattccgcaagaatagatagaataagccttcaatttgataagaaagaaaattatcaacaatgtcttaatgaaaccctgcttaaattcccaacgatacaaaaatactacggtgattatggcgattcacttgaatatggggcttccgatgtagaaaattatagagctgctataaatatttgcaattatctgctgatgaaacgaaactatcttcttcaagactttaaatcttcttttaatccagtacggacattaaaaacacttttttcattcccaagcaatttaattgaattgataggatttaatccctctgcagtagcttcaagagttataaaccttggcggctggcttttatcccttgcaatcagcctttattcaacagaaataaaagttttaatatcagccttaatccaaaagcttatgaactgataaatagacaagcataaatagtacagacgattgatactttgaaagaatctcaccatcaaagccaaaaatcattttcaaaatgaaaaagcagctgagtgttaataataatgcgaggctgtttttctttatctttatctctctcacctcccctttctactgcttgtccacggccccgaccgtccagtcttgccctcctctttttcgatgcgctgttacgcgtcctgggtgtcttccagtaagctgtctacggttacgcctaatagcctggcaactctgtgcaccctccatacacttggttcattttcatcccatttacaaatactgctcctcggaaattcaaggcgtctttctagttgtgaaatagggatattttgtttatcgcacagagccttaatattgtcatatagcaaagcttcacctcctacaatttttgtagttgcgtaatattttatgaatttagcttgacattttgcgtaaaatattctagaatcagaagtgccaataatcaatttaagaatatacgcttacaacatgacattcgcaaaatcttgcgcaactcataattttattatacataaaattttgcgaatgtcaatagttaattgcgcaaaattttgaggtataacaaaaatgggattatatgaacgtatacgtgatactgccaaattgaaaggttattccgtcaatcggctggaacaagaactcgggtttgctcgtagctccattaataaatttaataaaaacatgccgagcggagacaaattgcaaaagattgcagaatttttgggcgtttctgtcgatttcctgctaacaggacaagaatctaatcctgaaacttcgcggattgaaaccctagcagctcattttgaaggagaaaaactttcagaggaagaaatggaagaaattatgaattatgttgcgtttgtaaaaagtagacgtaaaaaatagtattacacggggactacagagtaatgaatgacttagaaaaagaagaacaggaagcgacagacatcggtttacaaatcgattatgtcccttttaagagcgaaaatattaaaggtttatactgcgatgggtctatagcaattagtaatcacattgatacgtgtgttgaaagagcatgtatacttgcagaagaattaggacactttcatacttcttctggtataattttaaatatggaaagtgctgtcaatcagaaacaggaaaattccgcaaggctatgggcctataataaaatggttacaatagaaaaattaatttctgccaaggaagctggttgctctaaccggtatgaaatcgcagagcatcttaatgtaactgaatcttttcttcaagaggccatagattgttatcgttcaaagtatggccttggttttcaaaaaggcgaatacataatattatttgagccatttaatatttgcaaaatgtcaagtgagtaaaaatgctgtgattttatagaaaattgtaaatagataaaaaagaaaagaggtaataaatatggggataatggacaatctggttggtttggccaaaaatgaaattgaaaacactaaagcaaaggccttgaaacaggcagagtgctcaaaagacagaagtattcctttaagtatgtcttttggatttaaagaacttggactcggtccctccgccacacttcgccagaagttagacggtgccacatactttaactatgacgattcagaaatttataagattgtagattaccattggaatggacctacttatgattctgtgatgacagcgaacacaaaaggctctacaaacagtgaaacaaccaaaaaaggaaaatcgggaaaaatggctactggggctattatcggcacagtgcttttccctggtgtcggtacggttgttggtgctgctattggggcaggaggaaaaagcaaggcaaagactcaatccacaaacgagtctgctacacaacaagtacataagcaagttgaaaaagataatacagctatacttaaattacaaagaataagcgatgggacagtctttccaattaccatcgcctgcaactcgaagaccgattctcaaattcagtgttttaaaatagagaaagaactttcaatctcttcttcatcaaaagaaatatcagattctcttaaaggaattaaggcactaaaggagcttctagatatgggagctatcactcaagaagaattcgacacaaagaaaaaacagttgcttaatcaataatacgaaaaaccgcccagcactcgcaatgctgaacggctttacatagattttctcttaccggacttccggaaagatatatccatctcatcaatggaattatatcatttctggaacgctctggcaagagggcgtatttattttacccatttttaggaggaatgatattatggctgagaaaaagaagaaaagaaaggatggacgatactccaaacaggtgaccataggactaaggaacggtaagccaatccgaaaaaccatatatggaaaaacacaaaaagaactggacaagaattatagggattttatgagtcttaaggacaaagggattatcttgcaagaggagaacatgacctttcgtgaattatctgacctgtggctcacgaatgaaaaagtaggaagcgttaaggagcaatcaatcacagtcatcaaaagccggctgaaaactatcaattcttacattggagatattaaagtaaaaaatcttaagcagagtcacattgaggaattccgtaaagtattaattgaatccgggaaggtagacagatacaataaatgtttatccacaatccgggcaattataaaatacgcagtccacaaagatattatggcaaaggatattacaggtggaatgtcacgagttaattatcacagaaaagaaagaagatctctcactcaagaagagcgagacttgattgaaaaagcagacttaaacgaatttgaatactgcctcgcaaatctcctgctctacaccggactgcgaaaaagcgaagcactagccctgaatgtatctgacatagacttgaagaagagaaagattaatgtctgcaagacccttgtatcaagtaagagcgttactgattgcttacaagactaccccaaaaccaaagctggcaagcggcaggtgcccataccaatgcctctataccctattttgaaagattatatttcccataaagacgggattttatttccctcaaaatatggaagctatatcgggttaaattatttttttaggcgctggaagcaatttatcaataagctccaggcggttagtgacaagcctctccctgacgatattaccgcgcatacgtttaggcatacttatgccagtgatttatataaggcaggagtagatattaagcaagcgcaatatcttttaggacatgatgatatcaaaaccactttagatacctacacccatttcggatacgcagatgtaaaggttgataagttagaggcttattacaatgcagtcaaaatgcagtcagagagaaaagtaatacccatgaaacacgcataaacaaagggtttcatgggtatgtatcggcaatagcaaaagtgcaacggactttttctgaaaacagacaaaaatcagtttacaaactttataatatcaaacatttgctccaatagcagccagtttgcccggaaaaattgcatgatctgccagtaccctgccccggtcaggccgtattccttgattaagtcaaacttggccttatagcttctcacatcctcaaaccatacctcatgctggactccatattgccaatagcggaaaaatggggacatagcgacctcatcaaactgaatctccacaccatgatcaatggcaatctggaccgcttccaaattgtttatggttcttgcccttgtcacacctctctcatagggcagaggccagtcatacccatagttggggatgccaaggctgatcttttccttcgggatctctgtcaaggcataatccaccactcttctgaccatgttgattggtgctacggccattggcgggccgaatgtatacccccactcataagtcataagcaaaaccctgttagctgcttctcctaaaagcctgtaatcaacaccttcatacaaaagcccgctctgagtagccgatgtcttgggagccagggccaccgtgacctgatagccgaactggttcatgatctgagtggtccgtctcaccaattccgcatagccaatacggtcatccgccataatatattcaaaatcaaaatccaggcctgcgaatcccttttccagcatcttaaggcctaagttccaggtcatcctctgctggacctccatattatgtaccgccgtagtaaccaagttgttgttaaaatgcccgtcaggtccaagaggggtgagtgtcaaaatcgggcgcactccaagttgccaggccctttctatcatccagtcatcagggctcatgggcggcaccagatccccctccatggtaaatccataggaaaacacataaagatcggtcagatatggaagagtattttgcagattatcctgactgatgatcgggtatgcatagccgaacacataaagaggcgtcctatcttccgagggactttcatcacgaatgtaaagtgcctggccgacagccaggcggtacggataaccgatctggttatcaaatatcaggctttctaccggaatgccctgggaagcggcaatggtgtccacactgtccccccgctttaccacatatattctcatagtagcatccttttaccagaattggtaaagcatatgttgaaaaaatccgaaacatgacagaaagagacatcttttcagggctgttcagaaaatgatatgttctgctatgtaaaaggcggggtccggaataccggatgcccgcctttcatactaactagcaatcactctcgttgttgcaattctcttcattaatccagcggcaaggagcatttctgcacccgtctcggtatccctgccaataacatcttcgtttttcctctgcgcaaggatcattattaatgttaccacagttgttccaacatctgcaacagcatctacagcaattccttctattaccccagttaaagcagcacataatgcaacacctctttttattaaactttacactgtatactatgggacaaacagacaagttgtgaattcagaaaagtttgagaatggagcaatttccagacatttccacttaagttattgcattacctattttataattcactatgaggtgattactatgaattttatagaaagaaatctggcagcagaatttgatcgattaaaaaaagtcagtgaaggtgttaaagctccgaaggctccagcaggagaatttaaaaaaatactgaaagaaatggaacaaagaggtattgaaccgaaaattcgtaaagagttggaaaagtgaccattggcagccaatcaatggtttccacctcttctatattcattttactccgccaatcctggatgctgcagtgtgccatcctgatcagttgtgattgttaccaaatccatagccattttccctcctgaccctgaagcaaatcatgccagaccggctgaccggtaattccattatagaatctccagtcaccatctttctgataccagccgtatttcttctccggaactgccgccgtagatatcttaaaggctgcccaagtatgcgttgtatggctaaatacatatggatccggatatatcttccctgccacatcgcagtgtcagatcatgtgatctgcaggaatatcatactttgcctgcggctgtacataatacatttttcattctcattttctcaaactttcttaattatagattttttaaaaaacgtataatgcggtcggtcttctccgaacagccaatatctaagccagtcatctaacacgatcccagcaccgctaatccagaaccataaaaaggaaaattccgggcagatctgtcccaggatattacctggcatgtggctgtaatcccatattccccaaccgagccatatatttactatacagccggttaataactcaaagtatgtaattataatcatacctatgatcatttgctggaagaggggcatctgccaaggtatcaactcgttgatcaggcccaaaaccacaaagcagatgccgcctaaaagaaacatggtccaatgtgagcggctgcggaatgccagttccatacctatataaatgatcccgcctgtaaaccagagaaatacatatttaaacgcctgattcatcccttagctcctttctcctatgtcataaaggcagtttgtgccagatatgtttataaactattcctgtaagtaatatggtatgaggtatggagcatagcttttttaattatcagggatatgtcagccgcaggattatgccggcacgactggccatctgcaggatatacaatcttctccgccccggccgcaagccgcatctgatatctccatcaccccttctgagcactctggcaaatccgattattattctccctcagctttttggcattcgaaaacccatttacccgcttattctttttccgggacttttcaaattcctttgccacgattaagccgcatatcaatcagtccttcatggctaccaatcatagttccaaacttcctgacaagatacacctgaaccataattatctttttatctttcagtttcacattttgctttctttctccttaccagcggctcccaaagcaccggatctgggcataatcatgtacacggatagggggatagcgggacatcattactgataaggtcataaatggagtcggttttatggatatatctgcttctgcaaagggaatcctttgtgcttgcacaaattgaacccggcgctcttttgatgattttctcaatgtagttctgcttcttgtaaaaattcccatgtacttatttgtacaactaatgtaaactagttttatataattcagaaaggaaaactattatgtctaaaaataataaaaataattattctaactctggtttagctaccggaatgagtctaggcttgatatttgggttactatttgataatctcgcctttggtatcattataggcatgataattggtctaataagtgaccgcaataaaagcggataagaaacaacatattatttttatgaaaattgcctgttatgcatattcgacatattaacaagctttatggcttagccttgattattgcttatcccatggagtatttcccttgcaaaatcttcacatgcctatatatagccatctctatcagccgttgctctttcaacttctttactacactgcagctttgcctcatgctctaaggcatccgctatttcatgggtcttatcaatccattctcctgcctttaacatttcccctctaaagtatggacccagattgctatggtgctctggcatatttccgattatccaggggcgattcgtttcttgctgccgggataatgtaataatgatttctactctctttataataataaaaaaccaccttacatctttatacttattgaattctattacacaatatgatacgatgcgaattaacacaaatattatggataattacattattataagggggggggtaacactattggatttacaaaaatacaaggtacttgaggattacatgctttcatgtatgaaagatagcgcacacgataaagatcatatttacagggtcttatatgttgcattagacattgccagccaggaatgtaatgtaaattacgatgtgctgatttgtgcctgtctgcttcacgacataggccggaatgaacaatttaaaaaccccaaattatgccacgctgctattggctcccaaaaagcatataactttttaatttctaatggttataaagccgaatatgccacacatgtaagttcttgtataaaaacacaccgatttcgtaccgatgcaccaccacaaagtatagaagcgaaaattttatttgatgctgacaaaatagacgcaacagggactctcggtatagcacgtaccattttttacaaaggacaggtatctgaaccactctattcccgtttttacacaagcagggggctagaagttgcatcggaacgtcgggcagctgcaatatctttctatgaaagcatggtgcatgaagtacaatcatcatatagggttggcagggaattacttcgtggccaaataatcgaacaagctaataattagtcaaatactttcacaatctcttcacatatccatcaaattcctgtcacaatttccaggtatattaataatcacaaagaggttaataaccctttaatatatagcttcttttcatgcttcagccggcagggtttcgtctccttgccggcccctttcgttttaaggcaaatacttcggaaaatcataatttttataatatgtttcttccccctctattgagttaaattcttagcattttgcatattattttttgttctgcagacactactgaaaagcgaaaggagcatcaatcttgaataacaaagatatatcttccaacaaacagggcagtgcaacagacaataatgccagtaataaaaatgttacccttacagatcatcgttcgaaaaccgcattaaatagcgattatattgatccattttatactcctccgggtgaaggccctaaacctagaattacatccaattaagcatcatccagttacgcaagggagatttaaatctcccttgttattctttgcatcatctttccagcacctgttatgcattcctggcagattttacagtgggatcatttggcctttttaatcagtttcttgtcgtgtaccatagttaggtttcttttttctgtaaacctaattatgctgaataatcaaccgctcaaagagtaagtcccttttcctgtatggctgctccatttattaataaatcccttgtaaaaaatgatgttatcttttaatgagaactcttcatttaatccggatcctttaacgtcaatatcaactgtaaccgccactctcatagttacgccttcctttctctgtaagtatcagtcttctggatttaccgcaataaaaaactaccagcaaaatactgaactgctccctgacaagtagacagtgttaaagaataaacaattttacatttaaatagtctgctacaaggggagtatatcatactgatagttagtagttctttaacctatttatattattggctatacataatgagcaatatctttcaaataattatttagcatttagcatgcgcctttttatagccagaatccctagaacaaggcctgacaacagtgcagccaatccaaacaggtaggatagcggaatcaaagcaaacggttccaccagaaatccttctgcagttacataactgccgatcatattaaatgccaccaggcaccccacactggcaataatcgaaaaaagtaatgtgcctgtgaaaaaagatgacaatctgtcctgtttccatttctttgcaatattattcataatttttacatcctccgtatttttaaccgcttttatctctatatcaatttgcttcagctcgccacggcacctttcacaggttgataaatgctcttcaattaatttgcggctgtcctcactgcatacattatcgtgatacaatggtagcaggtcctttattatttcgcaggttattcgcattctatcctctcctttaatttcatttttgctcgatggtaagtgaccctcgcccagctttctgttttttcaaataagctccctatctgtgaaaaggataagtctccaaacacccgtagcataaaaacctccttatagggttcgcctaaactatgaagctctttgtgaattttatatacagattctttcgataacaggctctgctctaacgttgaatcagcaagaatatcttccgcctcagtcaagtctttaagacacttttctttctttttgtaggtgaaaaatgtattttttgcaatttgacataaccacacatagagtttgcacttcccatcaaatttatcgatgttttttaaagccttaaaaaatgtctcttgtgttatttcttccgcaatcatttcatccctgcttatcgacaaaacatatttatagacatccttgaagtaaagaatgtatatttcattgaagtcctccactttttcacctcgctttcatacataagactacggaagatcgaattcgttacaaatattttttctcggcatagtaattaaagattattttatctccaactaactatcagtattaagttttcaatacctgtaaaatatgctattataaaacaaaactatataaggaggcactatgacacaccatatcattgtaaaatttctagatactgtttctaataaagaagaattaatcagccaaattaaggatctgttttcacatgcaactgagatccctggagtccatcaggttcagttgttctcatcttgtattgacagggcaaaccgctatgatttaatgataaaaatggttttggaaccggaaactctgaatgtatgggattcatcggaggtccataaaaaatggaaggatgatttcggacaatatcttgcagccaagactatttttgattgcaattaaaaagtgcaccacggtttaaatatggtttaagaacatcttttggagcccatgcggcaacattacttcaattaaatccggtatctaatagatagtatccgtcatgaacacatcttacaccggaatccactgctattctttcatgtttctttctacttccggcccggtcaggcctgattaggccggaaggttatgtaatgccggacataccggacgcattgctcctgatctgcttctacaaagcctgaaactatctctttgaggaaatccttttatatggttaccgcgtccttgtcctggcaggtaatacgcattgcacatgtacagcaccatgaagctttttgtggtttataagatgcctgttttaagaaatcgtttttatccatcgttcatcctccttaaaatatcagctttatgtgatttaaaaaaactaccagcttaatactgatagttagtagttttctttacatgttcactttattaactttgcattatgcacataacaggaagttatatgttttttaatttaacaggaataaacgtttccatttgtgcccagccttgagcatttataatctcttgtggtgtaatgatgtgtcccattgcataatgatttgagcgaatatctaactctaatatttttgagtttacaataaaatttatcgcttccctatataatttcccgtttgtttcttcatcaccatccttataggcataggttaggtaatagccgccatcaaaattaattacctcattaccaccgtcatcaatatcctcacttaaagcccacatccacaccattccttgtttctcattatcaaaatacaaaaaatcacgaggtctaaagctatctcttgggcacaatttaatggctgaaaaatacttgtcgaatttgttcaaaatacttcccggtgcaaaatcacactcatttgatacacctgatgtagatgccttaaatggtggcaatgatataattctgaattccatatttgttcccccttgtatataaattagctacatgaacagaataccaccatacttactaactatcaatatgaagttttcaatgtacatttctctattaaatgctaattttttcacactcaaattaccaacctactatcaatttcaaataacctgttatacttaaattaaaaaaatttggaggtttttatgatttcttattttttgctattcgcacagtcacttgaaatatttaagtatattgtatatgtcatggttttcctatgctgcattaagtatctaagaaaatgatttcctaaactctccatcctaatctgcttcattcgcacaaagttcaaatacaacatttctttctggcaacaaaaaactaccagcttaatcctgatagttaggggtcatctttacatattcgattttatcggttccgtgttatgctcattagtataagttgtaattacaacttcttttccatttccacataaagatcattgcgaaatgtttcataaaatccagaatgtcggtacaatgtaatggcgggttcaagtgtaatgcgggtactcaaatgtaacgcttggtcaccacactgctttgcatgtttttcaaccatatcaagcaatgattttgatattccgatgacgtataattaatttcgcaaatttaatttcataaaaatagacatggtctatagccgtttggtagaattaagttaccacacaaaatactctcaaaggaggctatagaacatgtctgataatattatacaattaaatcaggaacttatccataacgaattgaaagatttagtacgcaacagcgttgaggaaaccctcaatgccttgctggatcatgaagcagaagaactcgttaatgcggaaaaatacgaacgttccggtgaacgcaagggatatcgttccggccattacagcaggaactttcaaaccacagctggtgaggtcaaattaaagatgccaaagctaaagggtgttccgttcgaaactgccattattgaacgctatcgccgcagagaatgctccgtagaagaggctctcattgaaatgtatctcgcgggtgtttctgttcgccgtgttgaagatatcaccgaggcattatggggaactaaaatttcacctggaacaataagtaatcttaataaaaaagcttatgaacacattgaaacatggagaagccgcaaacttagcggttcttatccatatgtttatgttgacggtgtttacttaaagcgcagctggggtggtgaagttcaaaatgtctctatccttgttgctattggtgtcaatgaagatggatgccgtgaaatcattggcacagcagaaggtatgaaagaagatcgtgaaagctggaggacattctttgtatggttaaaagaacgtggcctggctggagtgcgcctaattattggtgataaatgccttgggatgctcgaatccattccagaagtatttccggatgcaaagtatcaaagatgtacggttcacttctatcggaatatattttcggccactcctcgtaataagatgaaagaagtctctatgctgctaaaggctattcatgctcaagagtgtaaggtatctgcaaaggaaaaggcaaaacaagtagctgataaacttcgcgagatgaaattagcttcggcagctaaaaaggtcgaagacggaatcgaggaaacccttacatacatggattttcctagccagcactggactagaattcgcaccaacaacaccatcgaaagacttaatagggaaatcaaacgtagaacccgggcaattggcgcttttcctgatgggcaaagtgctttaatgcttgtatgtgccagactacgacacgtagcagggacccaatggggtacaaagcgctacatgaatatggagcatctaaaagaaatggatctccaaaacgagtctgatatcatagccggctaactaccggctaccagacggttgaaatacaatttgcgaaaaaatcttgacactatcgatattcctcgtccacgatattcatgcttaataaacatacgtttaacctcgccaacaccaatagatttttttcgataagcaacgcatccgattggcaagtcgccaaagtaggccacccaaacattttctatgttttcatttttgctatagcgggtataataaacactatcaccgccgagaaactctatcataaaattatcttgttctgaaaagagtttaacaacctcttcggaaataacatctatgagtgctatcttcataggtacaacctcctgtaaaagatataattaatctgaagttgacattttatcaatattcttcatgagtagaatatcaccatacttattaactatcaatattaagttctcaatgtacctgctttttcacaaactcttcacagatccatcaaattcctgtcacaatttccaggtatattaattacaaataggcaatggcctttatacataaatctttttcacacttcagccggcaggattcccgatcttgccggttcctctatttttatgggtttgttttactccccgttgccgacttctctatcgtattggtttgatgttaaaccagccgctgcaatacgcttccgacatcatcaaaaacatatggccccatatttactgcttcctctgcgtccaatgcaatattcaggcagttcacctgttctgaaaatcttcccacatctctggagttggcttcttctccagtgataccgtttattttagtttactgccttccttgagaacttcatcaatttttccacttgaatcagccattccagtacttctttctgtgcccctggcaagtgatattactgcgcatatcttccggcatacctgtgagagcaatctatacaaagctgaagtggataataatcagacccaatatctctctggacacttactttcattttggatacgtgtatgtaaaagtggataaactggagtcatattataatgcagacaatgataaaatagcagctttctaatacgcataaataaagggtttagaaaaatcataaaaatgtaatgtgcttttttacggccttcgttgtataatattgaaaaaggaggttttcgtatgcagaatattttagtatgtgatgatgacaaacaaatcgtggaagccattgatatatatttaacaggagaagaatttcatgtgatcaaagcctatgacggttatgacgccctgaagcttctggaggatcacgaggtggatttaatgatcctggatgtgatgatgccggggcttgacgggatcaggaccaccttaaaagtccgtgagacaagcagtattcccatcatcatcctctccgccaaatccgaggacacggataagatcctgggattaaacatcggggctgatgattatattaccaagccatttaacccgctggaactggtagccagggtaaaatcccagctgcgccgctatacccagcttggtaatatgaaccagcagccggcaggacaagtgtataaatgcggaggcctggccatcaatgacgacaacaaggaagttgccgtggaaggcgagctgatcaagctgactcccattgagtacaacatcctgctgctcctggtaaagaacgccggtaaagtattttccattgacgagatctatgaacagatatggaatgaagaagccatcggcgccgataataccgttgccgtgcacatccggcacatccgggaaaaaatcgaaatcaatccaagagaaccccgttatttaaaagtggtatggggtgttggctataagattgaaaaacaataggtgtatttatgaaaaaaagaacagattttgcagtcttcctgcacatgctcttctcccttcttgttgtcatcggcgtctccatcatgtacagcaattcccactacggagagggcatccgctggatcacccatgaaacctatgaggacacgcctgacttcacccgccagctcaaatccgatattgatgatatttttaactatgtaaaatataaggaagtatttgaaaccaacggaaagcttgattattccaagcccattgccagggttatggaaggtcctgggaccacaacggaatatacggtagatgagatgatacgcagggccaagtccctgggcttttatctgaatgaacagtttaaagtgagcggaggacagccggcctccaatgacggagattcctatgtacgggtggattaccgggcatatgaaccggattttaagatcacggagcctggggaagcatttctcaccatggaccagctggcctatgaggtgctgacccacctgggcaattactattctttttattaccgctttatccagaatcccagtaatctgaagttcgaaattctctatcataacacggaggaagattataagctttacagcaatgtttccggaaaaacagtaaatgactttaaggccatgggaaaatatctttacgtaaccggagaagccctttacgtggattccaatttaagtaatgttccgaaaaatgtttcttcccagcttgaaaagatgaatccctataacaacggcaattaccatatgaccatagccgtggacacttcctatccctttgatgacgcttacgcccaggcttccgcctcctatgaccggatgcgcctgctgttcatcattggaatgataagcctgtgcctggggattttaggctgtgcagcaaccctttacgccctcgtaaaccacatcgggcatccggataaggaacatggctctggtcctatggagcggatccaccggctcccggcagaaagctgcatgcttctgtttgccggcgctgccattctgaccctgtttcttgcaaaccaggtggcatataagatcattcatcttttcctttctgatgaactatgggattacggagaattggcactgcgtattcttatttattacgcagccggactgtcagctgccttaagccttttaaagcggtataaggaaggtaatctctggaccggaagcctaacgtaccggggatttcgaaacctgtccctgtatgtaaagaaccaccgcttcaccacccggatcatgcttttctatatcctgttcctggtttttaacattggaatgacaatggcttttgcttttcttctgtttacctatagcagcctggaatccaggatccttatgggtgcagttgccgtattgtttttctgcctggattttctcgtatttcatcagatgtacaagaatgcatgggaaaccgaccagatcaacgaagctcttttaaacatttctaatggagataccacctataagatcgaaaccatggcatttaacgggaaagaacgggagctggctgagcatatcaatcacatcagcacaggacttgagacagccctccaggaaaaggtgcgtagcgagcgcttaaaagcagacttgatcaccaatgtgtcccatgatatcaagactcccttacatccatcataaactatgtggaccttataaaaagggagcagatacaggatccaaagattcagggatatttggaagttctggaacaaaagtcccagaggctaaagactttgacagaagacctggtagaagcctcaaaggcaagttcagggaatttaaagctggagatcaccagcattgattttgtagaactcatccatcaaactaatggagaatttgaagaaaagtttgccctccgccacttagaactggtctccagcttaccggccgaatccatcctgattgaggcggacggccggtatctgtggagggtgcttgaaaacctttataataatgcgtttaagtatgccatggaacacagccgggtatacgtggacattaccgtggaagggaatatggcagtctttaccatgaaaaacatttcccaaaaccccttaaacatccgggctgatgaactgaccgaacgctttgtccgcggcgatgttgcccggacaacggaaggaagcggccttgggatctccatcgccaaaagcctggccgagctccagggcggagatttaaggctttacattgacggagatttatttaaggcaggcgttgccttccccattaagaaataagccttatcctctcccactttcccgtcaggtagcggaaaaaagatatgatataattggccgtccagcccattggaaccgcaaaccaaacggcctggacgccaataacgggggccagcaaagcagccactgacacccggatcgcaaggtttaccagattggctgcagtaaacaccaccacatctcctgcccccttaaaagcccgtctgtggtcgctttaagaccaatgcacacgtaaaagaatgagatgaaccggacataatccattcccgtcttaaatgccgtttccgcacttccttcatttaaaaagcttcttatgaaccaatctcccacgtttccatgatgatacagatgatcacagcaaaaacacccaccatgaaataacagtaacggtagccctttttcacccggtctgtccttcctgcacctatattctgggcagtataggtggacattgcatttcccagagccagcatgggaacaatgcagatggattcgatcctggtccctgccgcaaagcccgccatgaccgcagaaccgaatacattgacaacggattgtacgagaagcattccgatatgaactatggactgctgaagggtggagggaattgctacccgcatcatatgaagcatcatattccagtcatagagccggaactgttccgttgtttcatacttctttaaccttctcatcagaatgaaaaatgacaggactgcggaaagcccctgggcgatcagcgtggcgattgctacaccggctactcccatgaaaaactggaccacaaacagcaggtccaatccaacatttaagagagaagaaaagaccagtaagtacagaggagtctttgaatctcccagggcctgaaaaaccgaggcctgcacattatacatgaataaaaaaggcagccccataaaataaatgcccagatacaccgcagcatcatcaaatacattctcaggggtattcatgaagcttaaaatccggtgattgaaaagaagccccagaccgcctaatatcacaccgatcaaaagaaaatttataagggtggtagatatggcggttttcatgtttcctgtctgttttgcccctaaaaactgggacacaaccaccgagcttccgattccgccacctaccgcaatggcaataaacacgtttgtaatggaataggaagcccctaccgaagccaacgcttcctccctacaaaccgccctaccaccacggagtctatgatattataaaactgctgaaataaatttccaagaatcatgggaagggcaaagagcaaaagtgcccttcccggtgaatctgttatcatatcaattgcttttctctgtgttttcatactcattattctgaaccattcctatccaaatattcgccagccgcaaataaagttgttcttccaccaggagcttaaagtacgttccactacccgtccgttactggaggaagcatcgatgacacttccgcctccggccacgattcccacatggccgctcaccacaatgatatcccctgccttcaaacttccaaagctggtgattttcgtatatttcccaacatttctccagccggaagaagttaagtagctctgcctcactcctgcctggttgagtgaccagtagacaaatcccgaacagtcaaaggactccgatcctttggctccccatacataagggcgtcccagcttggatctggcaatggaaagcagaccgcttacgccggagcctcccttaacggtgcctcccttggttgaaccgcctgaggaaccggaagagcctgcagattttatgctgcttcccgtaagcttgctcatggtaagctgtcccacggaaccatccgctgtcagaccattgttgctctgaaaggccttaaccgccttctctgtcacctcaccgtaatatcctgtcacattggcggaagctaagtacccgtatttatttaacagctgctggatcctggtaaccgattctccctgttcaccaagggtaaagccgtttggctgcgcttctgcgctcattaaggtgatcctggtggaaggccctaaatatccatccacaaccaggtcattcctggactggaactgcttcaccgctgtcactgtatcagctccgtaagccccgtccggagtggtggttaaatacccaaggtctttaaggcgctgctggctggataaaaccacatcacttttttccccataagccagaaagttgggcttgatctcttcgctgtaaagaaggtttatggtctgacgtcccacttttccgtctatgtttaagccgttgacttcctgaagcttcttgaccgcagcctccgtttcatccccaaagcagctggatacctggcctgcgcttgccagataccctaattcataaaggcggttctggatccgtgatatgtcctccccttccaccccctttgacacggcgtaatatttggcggatggggacataatggaatttaaggtctcaggccctacgattccgtcctgggtcagaccgttctggcgctgataggttttaacagctgcctccgtcacatttccaaaataatgggtaggttcatcgttatccataaagcctaaattcatcaatcgctcctgaaggctggccaccaccggatgctccactccattgcgcaaatactcgggaatggggttttccttttgttccggcaccataagcagccttggcattaaatccccgccgggcgtgagtatctcaatgggctggatctcctttttttgttccgttactatagcaatggagggcgtagcatcttttctaagttccgtgaccgctgacttttcaccgcagcctgccagcagggacgctgctgccgctgccagaaacacagaataggccgaacgcctcttccatcttatttttatgttcataaaccaaattcctttcctaattattgcccacgctttttgggcataaagggatacccgaagggtgcttcctaattattgcccatgtcctttgagcataaagggatacccgaagggtgctttttatgtaaaaccaggtctattttaacataaatttgtcggaaagggaaagggaatttatctcattgcgcccaaacagaggttatgatatagttaaagcagtgaaaatacagtcagaaccgctgactttaaacagaaaaggagggatttttatgtcaccgatcttgtgggctgccggcggtaccggctttacattcctcatgaccactttgggagcttccgttgtattcttctttcgaaaagaggtaaaccagtctgtccaaaggatcttcttaggttttgccgccggtgtcatgatcgcggcctctgtctggtcgctgcttattccggccattgaagaagccgaagcaaaggggattccaggctggatgcctgctgccggaggatttattttaggagtcgtttttctcatcgtgttggataccctccttcctcacctgcatcctgatatgaacgctcatggaaacaatgaagcagaaggaatttcttctacctggaagcggaccaccctgctggtcatggccgtgacactacataacattccggagggcatggccgttgggcttgcttttgccctggcagcccagcacggaagtgatccggccctttacactgctgccatggcccttgccattggaatcggtattcagaactttccggaaggcgccgccatttcactgcccctcagacaggaaggtctttctacgggaaaggcatttttccggggcagcatgtccggcattgtagagcctgtattcggaatccttaccgtaatcgttgcaggcagtatccagccgctcatgccctggcttctgtcctttgccgcaggcgccatgatgtacgtggtggtggaagagctgatacctgaggcccacctgggagaacattccaatgcaggaacccttggtgttatggttggatttttaatcatgatgattttagatgtagctttagggtaataaaaaaggatatccgggagacagacttgttcctcccggatatccttttttattttacatatgttttcctgtcaaaggttatatttatgctttgtgcgcagtctggctaaggatctggctaaagaagcctcaaaatgagaatgctcctgaatgcttttaccctgccttagctgctcggccgccctttctctggcttcctcagcccggcgttcatcaatgtcctccgggtgctctgcagtatcaacaagaagcgtcacccggttattgatgatctggatgaagccattgcctacaacggcatgaatccactggccgctttcatccatcagacgcatctcccctatggatactgcaataaccatatcctcatgatggggaagaaccgccttctcaccatccgcaagaggtatgataagcttttggcactggcctttataaaatatcttatcactggcaagaacctgaaggaaaaatgtttttgtactcacaggcagcacctccaagctaagcctctaatgttccggccttttcaatcacctcatcaacggttcccacgttaaagaacgctgcttccggataccggtccaaacttccgtctacgattgccttaaagccgcggaccgtttccttaaggggaacgtatttgcctgcaactccggtaaaattctctgctacagagaagggctgggataagaacttctggatctttcttgcccggtaaaccgtggtcttatcctcatctcccagttcttccatgcccaggatcgcgatgatatcctgaagctctctgtatttctgaagaatctcctgaaccttacgggccacttcataatgctcttctcccaccacatccggttccaggatacgtgagtttgacgcaagagggtcaactgccggataaataccctgttccacgatttttctggataaaacggtggtggcatccaaatgggcaaaggtcgttgccggggctggatccgttaagtcatcggcaggcacataaacggcctgaacagaggtaacggaaccattttttgtggaagtgatcctctcctgaagctcgcccatttccgtagccagggtaggctggtatccaaccgctgacggcatacgtcctaaaagagcggaaacctcagagcctgcctgagtgaaccggaaaatattgtcaataaataaaagcacatttttatgctcttcatcgcggaaatattccgccatggtaagtcctgtctcagccacacgcatacgtgcacccggcggctcattcatctgtccgaacaccagggcagtcttagaaataacgccggattctcccatttcggtccaaaggtcatttccctcacgggaacgctctcccacaccggtaaaaatagaatatcctccatgctctgtggcaatgttgtggatcagctcctggatcagaaccgtttttccaacacctgcgccgccgaacaaaccaatctttccgccttttgcataaggagccagaaggtcaataaccttgatccctgtttccaggatctctgccacaggactttgctcctcaaaggctggaggatctctgtgaatgacccactccggaccgccctctaaggctcccccgttgtcaatggtctctccgagaacgttaaaaaggcgtcccagagtctgctcgcccacagggaccttgattccttcccctgttgcggttacctccaggcctttatacagcccttcactggaagccagcataatgcagcggactgtgctgttgcccatatgctgtgcaacttccatgacgcagcgtctcccttcattatccacctcaatggcgtccttaatgcggggaaggtcgctgccctcaaaaaattctacgtctactacaggtccaaggacctgaacgatctttcctttattcatattctgttactcacagtcgtgaggactcctcctctctaaagtcaaccggaacatccggtgaaacggacattcgcaggctgcattcaaattacgctttcttccttttctttttctgagcctttgcaccgctgattacctcggtgatctcctgggtaatggctgcctggcggaccctgttgtaggtgattgccagctcgtcaagcatttcctgggcgctttttgttgccgcctgcattgccatcattctggaattctgttcactggaataagattccaccagacctccatagataaagcctgcgatgtaattgggcacaatggcatcgatcactgcctgcggagacggcttcatggtgatctcctccagatgcacgttaatgggaacgctctggcttaaccggtgcttgggaagaggaagaagctgctcgatctcagcttccattttcatggcattcaccattctggtgtagatcatatacacctcatccagctttccggacaggaagtaatccacgattttttcttcaatgatcctggcccggctcatattgggcttctgtacggtataccggaaatcctgttctacgggtatgccttttttcaaaaaatactgctgtcccaaatcgcccacaacaaacagcatgggatttccgcccttgtcaatctgctcctgagccagtttaaaaatattatgattataagaaccagcaagccctttgtcagccgttaccacgatgtatccgatctttcgttcttcttttttaatatgcggcctggtatccagataggggtcgtcaatgtcgggcgtatgccttatgatcctgctaatggtcctttgcagcgcatagaaataaggctccgtatcagtcagggctttccttgcccttttcagctttgacgaggaaatggtatacatcgcattggttatcttcatagtgcttttaatgctgttcatcctgctttgtatctctctcgcatttgccatatcctacacccgtttctgtttaaattcggctgttgcatcaagaattttctgcttcagctcgtcggacaacgccttgctttcttcgatttcctttccgatttccggatgagactcatcaaagaaggccagcaattctctctgaaattctttgatcttagaagcttccacatccaaaagcagccggttattggccacaaccagactgatcacctgggcatgaaggcttaaaggatggcctaagggctgctttaacagctctgtaagcccctttccatattgaatctgctccttggtagccggatctaaatccgagctgaactgggtaaacacctccatctcccggcactgggccaggtcgatacgaatgcttccagcagcctttttcatggccttggtctgtgccgcgccgcctacacgtgatacggaaagaccaacattgaccgccggtctcatgccggcgaaaaacagatcgctttctaagaatatctgtccgtcagtaatggaaataacattggtgggaatataagcggatacatcaccggcctgggtctcaataatgggcagagcggtaatggaaccgcctcctgcttcctcgttcaaccggctggaacgctccagaagtctggaatgaagataaaatacatcgccaggataagcctcacgtcccggagaccgctccaaaagcagagacagggaacggtaagccactgcatgctttgacaaatcatcataaacgatcagcacatcttttccctggtacataaaatactccgccaaagccgtccctgcataaggagcaatatactgtaagggagccggttcactggccgtggatgacaccacaatagtataatccatcgcgccgtaatgagtaagggtattcaccagctttgcaacggtggaagccttctggccaatggcaacataaacgcagatcacacccttacccttctggtttaaaatggcatcaatggcaatggaagtcttaccggtctgacggtcgccgatgatcagctctctctgcccccgtccgatggggaacatggagtcaatggcaagaattcctgtttccatgggaacggatacgctcttacgttcaataatgccaggcgcttcatgttcaatggggcggtaatcgtcagagatgatctctccctttccgtcaatgggtgcaccaagagcattgaccactcttccaacaaatccttcgcccacggggattcctgcgcgcttctttgttcttgttaccttacagccttcccggacgtcccggtcggaaccaaacaggatgcagccgatatcttctcttctgatatcctgtaccatgcccttgattccgttatcaaaaataacaatttctccgtacattgcacggtcaattccataaaccgtcgcaatgccatcgccaacgcttataaccgttcccacttcctggtccctggcatgagcgtcataatcttcaatctcacttctcaatatagaaataatttcatctgaattgatggaagccacgtttttcacctccgcattattttttgttccaattctttaagacgtccctttaaactccagtcagtctccacatctcctacgcggatgatgaatccgccgatcaaaccttgatcaaggatcagacgaagccttacatcttttttatcatattttttacgcagcattcccttgatttcctgaagctgttcttcttccggttctgtcacatagtaaagagaagcctccagaatcccttcctgtctgcaaacacaggcacgccatgccttaaaaatgtcatctgcaagatccatatcccggcgatccaccagaacctttaaaaaggtcctgatctcaacaggaaatacacggtcaatgacacggtgtttgctgctccttgccaccacaggactgttaagggcgcgcttaagctccggcacagtccttagtgccagagctgtttcctcaatggctgtttcaggaacagaaagctcaaagagcacctgcccgtaattaattgctgcctgcatcatggaaatcacctgcttctgctataaatgaatcgtaaagcgcctgattcgccctggcgctcacctcctgattaaccaccttggctgcagctgcgataaccaagcccgcgatctgtgccttggcctcacgcatggccttttcctgatcagcctccgcttgtttcctggcttcggccatcagacggcctgcatcctcccccgcatcctttaagatccggtcatactgggcctttgcctgggttctcgcctcttcaataagccttgatccttcttcagaggaggcagccagcttttcttcatactgctttctaagctccgctgcctgaccttccttattcctggcatccgaaatgctctgctcaatcataccccgccgcttattcatcacatccataaccggccctatgaggaaatgcttaagcagaagatacaggacgatgaggtttacgatattccacacaaagttcatatccagtctaagcatctgtaccgcctgcctttctttttattttttccgctttcattccgaccttgcgaattatttgaggaataaaatgatgagaagggctataacgaaaccatagatggcagttgcttctgcaagtgcacatcctaacagaagggccttgctgatcttgccttctgcctctggctgtctcgcgatggcatccactgccttggaagttgccaatccgattccgactcctgctccaatacctgtaagaactgcgattcctgctccaattgctactaacataataattctctccttttagtttttaatgacttactccactgcttccctgataaaaagtgcagttaaaaatacaaatacataagcctgtatcaatccgtcaaagatatcaaaataacaggtgaacggaattggtacgattggcccgacaagctgcttaatcagctccataactacgaatgatcccaaaacattaccaaacaaccgcatgcacagggaaagcggcctgattaatatttccagaacgttcatgggggcaagaagaggcaacggctccccgaagctcttaaaaaaaccctttaccccttttttgtgaaagcccgaatattctatcagcagaatgctcataacagcaagcgctgcggtggcatttaaatccttggtaggcggcttgaatcccaccatgccaattaaattggctactccgatataaatggccacggatatgagatacgggatatatcgttttccctcttctcccaccaggtcttcaaaaaaattgtaaattccgccgattgccatttcaagcgccaactgcttcttcccaggattctcaaccttaagatttctcaccagaatgatggaaaggagcgtcagagctgccatgataatccatgataccactactgattcagcaatggggatcccaccgaatatgggaatggtaaaaaccgtttcgcagttcagttcctctaataacttctctgccaaatcctccgtaatgctcacttcctttcttaaccgtcctcctcttaaatattaccaattttgtaaattgtactcctaaatatacaatgttacaggaggtataccgtgtatcatactttcatcttcaggaattgtcaactttttgcagaattcgtaacatcctgttaatgccactacttgtttgaacaattaaaacaattttatcctatgagaatctaaaatttttattaattttttaattcaaaatataagcaaatcataaagtgttttcttttcagccaattttctgggttttatgtagaatttttttctaataatttgtgaattttgacggcgttttttttttgattttttatttcaccgtcattagtgcctaacacaattataattagataagaatagatagggaaaagagatattcactcaactatcaaaacccatagagctatcaaatcccacaaataccttgtaaacttattttccttcctttcatgtctttcttcctattaaaatggacatgaatctggtataataaggtaaatataaattaaaatgcatcaaaggaggtattactatgggagaaatgatttcttcatttgacggaaccatgctgtttttaaacagggaggctccagaggctgccagggggacggccgtcatcgttcatggactatgtgagcatcagggaaggtacgattacgttgcagagcagtttcacaaggccgggatcgcaacctaccgctttgatcacagaggccacgggcgctcccaaggggaacggacccactatgaagattttaaccagctgcttgatgacaccaatgtggtggttgacatggctatacgggaaaatccggatattcccgtattcttaatcggccacagcatgggaggtttcaccgtttccttatacggcgcaaaatatacggacaagaagcttcggggcatcatcaccagcggagcattgacaaaggatatcgccgggcttataagcagtgttcccaaaggcctggatccccacaccatgcttcccaatgagctgggagcaggcgtgtgctctgtagccgaagttgtggactggtacggcaaggatccccataacaccaaaacctttaccaccggcttatgctacgctctctgccagggaatcacctggtttgaggaggccgtcacaaggtttcagtaccccattctcatgctccacggagaaaaggatggcctggtaagcgttcaggatacttatgagttttttgcagctgctccttcaaaggataagcagatgaaaatttacggcggcttgttccatgagatttttaatgaatactgcagggatgaggttatcaatgatgtccttcactggatccaggagcggatttccagttaggagaacgaatattatcgcattcagtttcaggccatagcaaaagcagcgtttatccataaaggaaaacgctgctttctcttttttattttatcttcaggctctctaccagtgaaggaccgtgcctcctaccttctgtttctccgtatcaaacacgatgactgttccaagccccttcacgcctcctgccgtcagtaagtcacaggaacccccaatatctctgtgggctaaaatgacaacatatttctttcccttccagccaatggatattgcttccgcatcagacgggcttaagggaacggtgggatcagccccgaatacggggagcatggaaagttccggcgccttgtatttcttcttttcccccctgaaacaacggttatgatggaagaaaagccttctgtttctttgccggccaaaagctgttttcccgtctccatctggttataatttctggaaatccatccttccgacagtttcatctcgcacccgtccgtgagaacagtcagttccccgtccgcctgaatgccggagtagcgcacagtacgcccggaacgggagatctttccatgattattaaaatggaaaagctgctgataggtatgggtttctctggaaaagaactcatcagcaatcagataaagatccgtatcaattgccagcacttttctggtgatccacacatttcccccgtctccgtttaaatatccgccgtgacttccctggacataacggtacccgtcctttgtcttatagccgccaaaatacgctgcagacatgttatctactgcccaggcatcccggcatgttaaataatcacggccatccaccaggggaacattgtggcccagagcgcttttaaaccaggttcttgcttcaccgggcacataatgatagcgccctgtatccataagcatgtcctctccgttgatcacaagatccacatgcagcttgtcggaatggccatggcctcctcccaggaatccgcagcggaaatgaaaataatccgcgttttcatcccaaccggaccggataaaaagatttccggtgctttccatgaccctgtctaaaaaatccggttcctgtgaatccaatttcccgtagccttcgatcccttcttttaagaaatcccaggctccgtcataatccatcttgtcataggcactgaattttaacaccgggtctgaaaaaagccaggcgctttgtgccagtaagtccctgagatcggtttcatcgctgtccccctgcatgggctggcagtggtttggctttttccatgcaatgtttgcataggccatctgccggatcttttccttcattttcttgggaagcttaatgctgtaccgtctggctaaccgcatcacttccagataacagtggaacacttcattatgatacatgggagactgttcccagtgcactccgtcatcagcgacctgcaccccaatctcttcgctaaggcgcattagggcggaatccagatactcccttgtcctgtcgcagataggaagggccagggcgatctccatcagtcccctgttctcaatcactccccagttgctcttgatctggaaatgcttataggttgtcataaggtactccccatgaactgtcaggcaatccatataagccttcaaaagtccgtcattcacagagggactgtctttaaaatagcccatggcctttacccaggtttcggcccggatccctgcttcaatactcctccatgtggtattcttagtttcttctgtcagagggttattttttatccaggaatccagcagctctgcaaaagtctttgcatatttctcatcgcctgttatggcgtatgcctgtcccaggcatataaaaaactggtggcggttaaactggaagataaattccggatcatcacccggcatatagtcccataccacttccccatcaaaatggaccggctcataggttcgttccatatcccacctcagatcgaacaaaaacgtgtgcttcgcagcatcatctgcaatcctcaggatatggcccacttcctccggccagttcttttgacaatactctgtgacccaggccttatcctcctgagtgatataattgttccggttttcaaaatattgtgcctttgacatctcattccccctcttccatgataaattattttgtttacttctattataaaggaaaaaccaaatgaatggaataaacgatttacatgattcttattctttttttaggtttgcaaatcaggatatttcactctcatgtgatatgttgtcatcccaggcgctttaccatacgttttaaatttatctgttgctaataaaagccggtagtcttgtgccgccttccggacaagtgctgcactgatcatgtccgggattttcgtgaatccgtcagacagataaagaaagaaggccgtccctcatctgctttccactaaaaaaaatcctggttttttcacattctggttgacaatttcatttctcagagctattatacatataaatccaatatgtttagtaggtaatgattcattctacaggaggaacacacttatgaaaaaatctgcagccccaatccatgttaccatgtgtatgtttaaggacatgtcaactgccatgtccctgatgtgttgcactcattttgtttcctgtgctcccaatccggtagataaggatctgtcattgcagcgctgatttcacaatcaatgtgtatttcatacatgcaaacacagcagaccaaaaacgggagcctgaaagctgcccgtttttttataggaggaaatgactgtgattcaattagaaaatatctcaaaaacctttgggacagggtctgtcgaagtccatgcggtccatgatgtgtcgctgttcattgaaaaaggggaaatattcgggatcatcggattctccggagccggaaaatccactctggtccgatgtatcaacttgttggaggcgcctaccagcgggaccgtcaccgtagacggacaagtgctcaccggtctgccgcccaaggccctgcgggccgccagaaagcgtatcggcatgatttttcagcatttcaacctgatgcgttccagaaccgtgttcgggaacgtggcctttcccttaaagggcagcggcctttcaaaagaggagacggtaaaaaaggtgagggagctgctgaagcttgtggatattgcggataaagaaaatgcttatccggcccagctttccggcggacagaaacagagagtggccattgccagggccttagccaatgatcccaaggtccttttatgcgacgaagcaaccagtgccttagacccacagaccacccagtccattctccggcttctccagaagctcaacaggcaattgggcatcactgtggtggtcatcacccatgaaatggctgttatcaaggaaatctgcaaccgtgtggctgtcatggaaaatggaaaagtggtggaggaaggagaagtattctccatttttgcaaatcccagagagaatgtgacaagggattttatccgtaccacttccaacttacagaagatcgaagggcttttggctgaagactctccggtcacacggctgaagccgggagaactgatcgtccgtctgacctatgtgcagaaaaatgtctcagaaccccttatatctacggtttcacgaaagtttgacatcaatctgaacatcatattttcagatgtggaaatcgttcaggacgcacctatcggaggtactgttgccattgtagacggtgacagggacagaatcaaccaggccatcaattacctgattgaaaaaaatgtaggagtggaggtgataaaagatgcaggaattgtttcttgatatcgtgcccaatgtggcgggcaagctgccggatttttataaggccatcagggacaccctggtcatgactttttggtccgggtccatttcctttttgctgggcttaattcttggagtcatcatcacggtcaccagaccgaaaggaatcctggaaaataaagccgtcttccaggtgcttgataaggtcatcaacttttttcgttccattccctttatcatccttctgacaggtgtcatgcctatttctcggctcattatgggaacggctatcggtgtgaagggggcaatcgttcccttgattttcggaacagtcccgttttttgcccgtcagattgagagcgctctggcagaggtagaccacgggctggtagaagcagccctttccatgggactcagccctctggaaatcattttccgggtctatcttcgggagagcatcgcgggaattgcccgcagcacgacgattacggccatcagccttttaggcctgaccgccatggcgggagctgtcggtgcaggaggccttggagatttcgccatccgctacggccatgaccggaatcagaccgacgtgacctatatcacggtcctggtcctggtactcatggtcagcgtagttcagattataggaaatcaagtcgttaaaaagagcacccattaaaaataaggagctttccggaggaaatgaaaatggaaattcaaaaaagaaaaatcgtaatcatcggcgcaggccacgttggatctcatggaggctacgctctgttatcccagggacttgcagaggaaatcgtctacattgatatcgacgagaaaaaggcagcggctcaagccttagaccttttcgactccaccgtctacttgccgaaacgggccatggtccgtgccggcagctatgaggacgccgctgatgcggagctgatcatggttgcagcaggacctttgcctgacatgagcaagggtcagaccagaatggataccttaaagcagaccattgaaatcgttaaagacatcactgaccatatccgcatttccggctttaacgggatcatcctgaacatctcaaaccctgctgatgtggtcacccattatattcagcacgtactggactatccggtccagaaaatattttctacaagcactaccctagacagcgccaggctgcggagggccatttcccaggccatcggcattgaccagaaatccattcaggcctacgccttaggagagcacggggaaagccagatggttccctggtcatcggtaactgtggccggaaagcctctgttccagcttatggaggaacagccggacacatacggaaaattgaatttggaagccattgcggcagaaggaaaggccggcggctggcatatattggccggaaaaggctccacagagtttggaataggagccgccattgccgaagtggtccgggcggtattcggagatgaggatcggatccttcccgtttccactatgctgacaggacagtacggccagacagatgtttatgccagtgttcctgcagtactaaaccggcacggagtgtcccaggtagtggaattgcggctgacagaggcagaagcagcgctgtttcagaagtcctgccagactatgaaggagaatttccagctggcgctgacgctttaatatggagtcaatgattcaaagcaaccaatcatttaaaataatcaaaatttcaaaacggaggaaacaattatgaaaaacagaaaacttaccgcaattttattatccgcttcggccctggtcttatcccttaccgcctgcggcgcatcatcaagcggcagcagcacccaggccacggaaagcaccaagtctgcagaaagcacttcccaggccccggagaacactgccgccgaaaagaccggagacccggttaccataacgctgggcgtggtgggaagcatttatgaagacttatgggctcccgcaaaagaagcattaaagtcagaaggcatcaacctggacattgttcagttctccgactatgtgaccccaacaacgctcttgccaacggggaaatcaatttaaatgcattccagcaccgcatttatctggacaatgaaattcaaagctacagctataaaatccagaacataggcaacacctttattattccgttaaacctctattccaaaaaggtcacttccgttgaggaaatcaaagacggagacaccgtagccattccaaacgacgtgaccaacggcggccgtgcattaaaggtgcttgaggcggcaggcttaatcaagatcaaggcggatgcaggctttaatcctaccaccgacgacattgagacctacaatgttcagattaaaatagaagagctggctgccaacaccattccttctgctctggcggatgtgacagcggccatcatcaacggaaattatgccctggatttcggcttaaagacagaagaagccatattcgctgacaccagccttggagaagaaaaatactggaacctggtggcggcccgcactgacgatttaagtgatccggaaaaggcggagttataccggaaggtcgtggaagcattccagtcaccggaaacagagaagatattcaacgatacctacggcggctatttcatcaagcagggctgggacgaggatttactgagcaaataagatattttaccggaggcagttatgaacatagataaaaatgccctgtgttccatcattcaggacccaaaacggctggtgttcgaacacatagagccccgtttcttaagcgacacgttaggacggctgaccggaaatgcagaagcactggtatttccggcctccgccggagaggtcagcaaaattctccgatacgcccacgaaaaccggattcccgtgactcccagaggtgcggggaccaatctggtgggctccaccgttccggtggaagggggaattattctggacctctccaggctgaaccgcatcctggaactggataaggacacctttactgcaacagcagagcctggggttctgcttcaggattttcaggcatttgtggaaagggaaggatttttctatcccccggatccgggtgaaaaggcctcctccctgggcggaaacatcagcaccaatgcaggagggatgagggcggtaaaatacggagtgaccagagattacgtcagaggcctggaaatcgtcctggcagacggcaccattttacaggtgggcagcaaaaacgtcaaggacgccagcggcctttcccttaagaacttaatcattggttctgaaggaactctggccgtcatcaccaaatgcatcttaaaggtgattccgaagccggaaacctccgtcagcgtgcttgtcccatttcctgatttaagaatcggcatggaaaatgtcctgtccatcttaagggccaacgtgaacccaacggcagtggaatttgtagagagaaaggtcatttccctgggagaggaattcatggagttccgttatccaaggccggatgcaggctcctatattcttctgacctttgacggcaggaaggcggaggtggattcctcgatagagcaagtaaaacgccttgtgacagaacacggcgcccttgactatgtggtcctgacagacccggatttagcggcaggaatctggaaggtacgcggagctcttgtgaatgctgtggaagctgtgtccgaacaggaaccggttgacatcgtggtgcctatcgataaaagccatattttcattcaatacatcaatgagctggaacgggatacgtccatgcagatggtcagcttcggccacgccggagatggcaatgtccacctatgcgtggtacggggaaaccgggacgaagaaaggtggcaaaaggaacttaagaagaacatggaaaagatctacaaaaaggcttacgagctgggagggctgacctccggcgagcacggcatcgggatcagcaaacgtccctattttcttacggaaacagcaggagagaaccttttggtcatgaaccggatcaaggatgccttagaccctctccacatcttgaacaaccgaaaatcctatatcacagaaggagagagcaatgcagaaattatctgaccggacggcaagctttacagactccgtcatacgtcgcatgaccaggatcagcaaccagtacggggctgttaatttgtcccagggcttccctgattttgaaccgccaaaggagattctggaccggctttgtgaggttgcctatggtgacttccatcagtattccatcacctggggagcggagaatttccggcaggcgctggccgccaagcagtcagagccaatgggccgtgatatcgatccggcaaaagaaatcgtcgttacatgcggcagcacggaagccatgatggccgccatgatgaccgtggcaaatccgggagataaggtcgttgtattttcgccgttttatgaaaattatggggcggatgccattctttcgggggcggagcccatttacgtgccccttcaccctcctttattcaactttgatccgcaagagctggaggctgcctttcagcagcagcccaaggccctgatcctctgcaatccgtccaatccctgcggcaaggtttttaccctggaagaactgacttatatcgccgggcttgcccaaaaatatgatgtgtacgtcatcacggacgaggtttatgagcacatcgtctacgcgcctcataagcacgtttatttcgcttccctgccgggaatgtgggagaggaccatttcctgcagctccttatcaaagacatattccatcacaggctggcgtttgggctatatcatcgcgccgccggagatcgtagatgtggcgagaaaggtccatgactttttgactgtaggcgctgcggctcccttacaggaagcggtcattcccgggcttaaattcggtcaggattactacgattctcttcttgaaaagtataccgggaagcgggagctgttcttaaaaggccttgatgacctgggactggtccatacggtgccggaaggggcttattacgttatgatggatatttctgaatttcattttaaaagtgatttggagttctgcgaggtactggcaaaagacgtgggcgtaggcgccgtacccggttccagcttctttaaggagccggtcaatcacctgatccgcttccactttgcaaagcgggacgaaaccttaatagaagccttgaacaggctctcattgatcagggaaaagatacctgtgagacaggcagacttataacagtaatggggtgatatggaggaaagctgtaaaacagctgggaataagggtgaaaatcaaataaatatgaactgttgtatcacataagacaccgctttagcagggctctgtgcagtgtaacagcaaaaggctgtatgctcccgtagaaggagtatacagcctttttgttgtcagcagcctgtttcactgcctggccgcgttttcttataaatttctatgggaatacagtcaccgaatactcagctgattctattggcaaaaatccataaatccagacaaaataaaagccccaaccccgcagctctctgtctgcaaaaccggaacttttgatgcgccttcgggggctcgaaccccggacaaatagattaagagttccattaccaggtttttagagtaattttttatgctctttcattgttttggattcgattcaggcttataaatcctttattttatgtcttaatatttttaatttgcatagactttgcaaagaacgcttgtatattctatcctacatttcctttaaatgcactttcctaaatttgtgtactagacgtatatatttcaataatcgtttttataaggacctcaccaattggagctgctaaattgcctaatcctatgtaatataagaggaaataacgaatttctaactgtggagcttaaattattaaatattattcagttcttattttataaccaatcataaacaaagctgccttatagctcttaacccatcttttatatcaagttttccaaatgattctacatctttcctatataactcttttactaaccaatttgctctaatattattttctaaatgtgaattataatgatttgtaattattgaaaatttgtatattcctttgtttggatttcttggattttcacctatttttgatttagtattcattcttaaaactccctaagaaaattttaattcttctggagtcatatccaacccactttcttgacaaaattttcttaccaaataacataaagcagccccaaccctactatcatatattacaaaatctctaacaatcaaagagtatatctttgtaaatccagaactcataaacaaatcaatattacgataccattctaacgactcatctctttccaaattttccttaacttttataaattcaattgccattttcaatgttgccggcctggaccaacatcttaccgccccacagccgtttgtaataatatatccaggcagccagagaagaaagcgcccagccgaccggtattgaccaggctaaggcttccggacccatacctgcgaataataccagcagatgcgccaataccgcacggacaaataaactcgccaccggaaataccatggccataacagaatcgccgacaccgcggaagaaaccgttgaaagcaaacaaaaacgcaaataagaaataaaagattaccatgatatttaaataattcagccctacctctgcaatgataccagcgtttatatccttccggtttaagaacatagaaatcagccatggccccaatgatatgagcacaacggaaataaatatcgccagcactaccatcataacaatagcaaaccgcagaccttttctcgcccggtcttcctggcccgcccccatattctgggccacaaaggtggagagggccatgctgacattgctcaccggcataatcgcaagttgatcaatcttcgcagcagctgtaatgcctgccatcactgcggctccaaacgagttgatcaacttggtaattgtcaagttagcaagacttaccactgaaagctgaatcgctgcaggggttccatattttaagatttcagtaaacagcttcggatcaaaggtaaggctggtaacatgtaataacggcaccttgtgcaaagtatataaatagcataaaactgctgagaccgcctgagcaatcagggtagccactgccgcacccaaaacacccatatgaaactgcataacaaaaacaagatccaatacagtattgataatggtacataaaatcagaatcagcagcggactgcgcgaatctcccaaggcccgcagataagctgtgtacatattataaaaaacaggaaacagcataccgcccatcaaaaagcgcagatacaatactgcatcatccataatttccggcgtagcatccagccaacgcagtagatgcggtgaaaacaaaattccggccactgccaccacaacagagaacacccccagaaacacaacgctggtagacaccatccgtttcattttatcatacttcctggcaccataatactgggaaatcagaaccgaagcacctgtcgttaagccaatcaacacagatacaagaaattgcagaatactcatcgccacaccgaccgccgccagtgcgttgctgccaacataacggccgaccaccatcgcgtcaaccatactgtatagctgctgaaagacattgccaatcaacatgggaattgaaaatgatataatctgtttggttatactgccctttgtaaaatcattcaacgaatttacctcatcccgatatctttttagtatattttgtaattaattataagcctcttataatcggtttgcaagtggctcagctgaatccataatcgtaataccattttccatccatatcctggaaccaccccttattcatatagccatttccatcaaagtgataccacttgccatctgctggattctttacccagcaagatatggcatatgtattatcattccgcagatatttccattctccactgtctaataaccactgtccctgagctaattccggcgaaagcgatccattgggcggctactcagcctggcactcagcacatggcttacctgcgcacttccgcatacccttcatgttcgctaacctataccaaaaacctgatcatcactggagtcatgagaagcactgtcaccattcgaatcacctgaaagatcgttacaatatctgtatccgccccatattccatggccaccatgattgtaggagaaagtcctgccgggcagcagcttaaaatacaggtaagcttatcccaacccgtcagcttcatcaggagatatgccatcaaaagtccaaagcccaccacaagcagactcagcaaaatgacaggtaacacatagtggggaaattccatcatactctccctggatatggaaacccctgtcaagccaccaatcccaatctgcaccatagtctgtaatttcctgtttattttacattccaggttcgctttccttacagccgctcccaccaccagcatagagcccagaatattagccgccggcatgtgaaatagatctaagagcttagcagccgccagggaaatcagaattagaatgccccacagaagcaaggagatcttttttccgcttactgacctcatgttatctgttctctcctccgggcacctcctgtattttgcagccaaagaggagaaaaatgtcatggagatcagcattctggaggattgaagcaatacggtcacaaaggggtcggaatgataattgagggacatcagggtaatttcagccataccgccgggcatagctgcaaaaaaggctgtctccctgtcaattcccatagttgtcagaacccagatgcccgccagggataacaaaataagcccagtaacatacactagcagctgcctgtacacgccttttaaactgtggttcatccgcagccccagaaacactcctgtgatcaccgataaaagtggtttctggaatgaaggaaccggaaggcgaatcccgagaagggtcaggatcataaaacaggcaacagggcctaaaatagcaggggcagacacttttaagtgtctgcctcccagatatcccagataacttacacaccagaataatataaaaccaacagcgaactccatcagtcagccttccactcatcaattctgggaccaaaggcaatgagaccgccggcatctaacatctccatcaggaaagaatctaccggctgtgcctgcaacacatcaccggtggtctcatttttcacctttcctgttgccatgtccacggacagacaatccccttctgatacatgatctgtaattcccggacattctacaaggggtagtcctacttcaaaagcatttctgtaaaataacctggaagcatactctaccaccacggcacccacgccggtagccttgatcgcctttggtgccacggccctgcctgaggactggccaaaatgctttccagctacaagaatatcccctttctgaaccttcttcgggaattccggattatagttttccaaaacgtgtttggccatctccgccatatcacccaaggctcgatccactcttactatctgatctgtgggaatattgtcaccaaatttccacactcttccttttatctcactcactatatcaccaccaaatcattatatttgatattcatcaatctttggtccgaaagctatcagacctccggcatccagcatttccatcaggaacggatcaatgggtctggcatgaaattcctttcctgtggttttgttgacaatcagaccgttttccatattgacagaaatgatatctccgtcactgactccctgggtaattcccacacattccagaaggggaagtcctatctcaaaactgttcctgtaaaacagccgtgatgcatactctacaatcactgcgcccacgcctgtggctttgatcgcctttggtgctacggcgcggcctgaggactgtccaaaatgcttccctgccaccaggatatcacccttttttacgtttttaggaaaatcaggatttaagttttccaacacatgtttggccatctcgtcaaggctgagcaggactctgtctgctttcacaatctggtctgtgggaatattgtcaccgaatttccagcatcgtccttctctctccatttctcaaccctccaaaaactctctgggatctgccacacagccttttacagcagatgccgccacagtgtatgcagagctcagatacatgattgcctcaggactgccgtttcttcccgggaagttgcgggcatgggtggaaatcatagcctcattctttgacaaagctcccatattgatagcctggttggatccggtactggccgggaaccaggaagcccctgcctgatggaagatttccacgataccttcttccagacattgctggaaagtctccctgctgcttggaacagcattgaattttacgccggaagccagtttacgtccctttaaaatctctgccgcctgtctgaaatcttctatacgaccaccgccgtggccgcccagctctgcccactgaaccggttttccggcaaagccaccggctggctttacatttccaagggtgggagatgctgcaacctggggttccagactgctgatgtcaaagctcatcactttctcatactcacagtcaggatcagaggtaatcacgtcgaaaggctcatccgtatatttcttaataaattcaatggttttctcatccggatcgataaaagcacatttgcctcccacatcaatcgtgattaacggaaacagccatctgtcccatacatccagatcttttataaattggccggtaaaatgaattgcacggtaaacagccccgccctctccgatctggccggtgagccacaatgccacatctcttggggtcactcctggctttgtatggccggtcagttcaattttgatggtctttggcaccataaaccaggcttttccataagccattacagtagctgcgttggaattatttcccagtccagtagcaaagcagcccatagttccgtgcacaggagtatggctgtcagagcctaccacaatggttcccggacgtacaaagccagttctttctcctacgttgtggatattaccggagccacagtcaaacaggttaatgtggtaccttctggcaaactcacgatttctctccaacacctccgccctctgctccgtaggtggtgagaaatgatgatcaaataccattgccacacgttccggataacgcatctccttttttacttcattgtcaaatacattggcggtaatataaccgcttaggtcatgaagcaaaagggtatctacattggctaccaccacgtctccaggctttacttcctttctcccgctggccttggccaggattttttctatcatattcataaaacaactgctcccttctctgtaatacggtacatattgctgcaacaaataccacttttcttttcatgcaccgccacatatagaacctgatctgtagtaatctcacatgccgcctggttcagatctgagatgacgtccgacaatacctcaacgataatctcaaagccttccgccccacaaggtactgctcttccaggtaacagctcaagagccactgcttccagctgtctgtccactgctgtcgtaactgcaccaaaggtcttcgtcagcttgacccaaatacctaagtactgcatcaacccgcagaccgtccatttaccacctgcatcctccattgtaacaggaagaccaaaggaattcccctcatgggaaacatagagtacgatatccattgcaccatttttcctggctccatactcgatttctgcagtcacggttttggaacttccgctccgggcatattcttctgccccccgttcaaatgcctggtgcaggattacggctgcttttgaagccatctctctgtaggagtcatctgttgtctgcataagtttcgtttgtatatcatctatggcaaccagttcaaatccctgcactttcaatgcatctcccaaatctgccatgatatattttcctatcattccaatccgtccgccctgagggaaacgttcctttaaggactgcgctgtccgggccggcaccttaaagcctgaggctaacagcttctcctcttcaattccggtcagagtatgtatccagggattgacacggttattatggcctgtcaccatataaacctctttttcagttatcactgccacactgttacaccagtaaggtgcataattcacataataggatagttcatctgctgaatacacatcaccgtaaaccactactgcctgtacattcatcttggcagcctctttcatcagtgcctgccttctttcctcaagggcagacagaggcagcagatttttatcccaatccatatatccacgcttcatataatcctccttctacacctcaaacagcttacgctctgtaacggaaagcagctcatatccatcctttgtgatcagtacaggatccccaaataccatgtagccacacagcggactgaaggtattgggatgaatcactaccaccatgttttcctttaacaccaaatcagtagactctaataccagaggcatctcatctaagtctaggccatgtccgtggcctctcactctggtatatttctcagtacagtattcaccatagccatacttacggaacacatcattttctgctttggccacatcactgatattcacgccggggcgtatcatgtcaaagccggcctgttctgcctccaggaaaatgtcaaaggctttcttctgattatcattagccttccccttcacacaggtacggcagatctgggcccaccagccattgacctggggcgttatctctgtacgcaccatctgaccaggctgggctacacgcatcatgggcggcgtcataccatacacatcttccccgcctgtggccagcagcataaaggaatcctcggcgccatggcgcttgatgtaatgctcaacctcagccacaatctggtactcattaagaccgtcggccacgcccttcataaatacgatccatgcctgatctgccaggcttacggcctgtcttaaatagccgatctcttcctctgttttctgcattctggcagtctcaagcttcccttcgcccgggatacaggagacgcctgccgcttcaacagcctgagccagattaagaggcatatatctttttcctgatattgccatgttcttcaccccagcctcttttaaaagccgggttactgtaccgtaaggatctgcgctgtaaacagtcactccctttaataagggttcatttttacattgatcccactctgagccataaatcacataggtcctatctgtttttgccagatacaggacaattccaaatggtccgataaaattctgttctgtcagaaaacggtaattttccttgtgccactgggggctgtagacgagaaatccatctgcctctagctcagaggttatcgtcctgagcagtccgattttctgaactttcattctatttcccctccgtttcggccttcagcttattcaacaaaccgcctgcggtcataatatccagaaggaagtccggaagcaccgtacccttagtctctgttttctgggttacgttcttgatgattccctttgagagatccacttcaagctcatctccctctttacaaaaatcacagatattgtcacattcaataattggaaatcctatattaatggcattccgaaaaaatattcttgcaaaactgtctgcgattacaagatttacccctgaaaatttaagagctctgggagcccactcacggctggagttgcagccgaaattctgtgcggccaccataatattcccatcctttagtttctcatgaaactgagaatcaatgtccttcatacatgccgctgccagaccctcaggcgttactgctgtcacatgggtagaagatgcaatctgctctgccgccacattgggtccgtaaacaccaaatactttgttatgtatcaccatagttagtcacctcaaatctttctaggatctgtaatcctgccgcttataacagacgctgccacaactgccggggacgttaagtaaacctgagatgtgggatctcccattcttccaaccatattccggttggaggtgctcagacatacttcattttttcccagaagtccgtaatggccgcctgcacatggtccgcactgaggattgcaccagatcgctcccgcatccagaaagtcctgaacaattccttcttcaacacactgcctgaaaatggttctggatcctgggatcacctgaaggcgtacacttggagaaatctttttacctttgatgatatcacgggcaatgtggaaatcttccattcttccgttggtacaggttccaagaagcgctcttgtaaatggcgttcccaccacttcactgactggaacagaatgctgggaaccgcctggcttcgccaccataggctctagcttgcttccgtcaatattgattaccttttcatagactgcatcagggtcagagtggacgatttcaaaactgcgttctgatcgttccttgatatattccactgttttctcatcagcttcgataatcccattttttgctcccgcttccacagccatattgcaaagagaggaacgggaatcaatgctgagctggcggatgctgctgcctctgtactcaatggctttatagcttgccccatccgttcctaaaagggtcatcacataaagcgccacatcttttccacatacatattcagaaagctctccctcaatattgatgagaatcgaactgggaaccttcatccagatgctgcccttattaaatacccaggccatctcagtagctccaattcctgtggaaaatgcgcctaacgcgccataagtcgtggtgtgagaatctgttcccacataggcatagcctggaaggatatggcctttctccggcatgatctgatgacagattccctcagagttataaaggggtaaatcatattcttctgcaaaacggatggtgtcggtaattaaatctgcatccataaccttgctgggaggcgtgccatgatccaccagaataatggccttctctttatcccatattttcaaacccagcttacggaattctgaaaaaaacaaagggccctgcttttccaccgtaaatgccgcatctactttaacctctataatttgtcctggctccacacgatccagtccagccgctttggctaatattttttcagttatattcatgttctgctatcctttctataacacatatgtaaatgcatctctcggacatacgccgcggcaaaatccacagccaatgcatttatcttcctcaacaacacactttttcgcatcgctgtcataagtaatcgcatcacaatgtgcaatcggcaagcactgcttacagccgatacagcgtttctcatctatcagtgctgtaacatctgcgtagtccatctctcccggagcacacacatatttggatgcaatccctaccatctcatctatagagctgtagccacactcgtccatgaactgttccaaaccctttaaaatctctttgccaagtccaaagcccttttgcataacagggacgcacatctgaacagcagaagccccatacatgatagtttccactacatcctgccacgtatataatccgctgccgccgatgacggcttttcccgtattagctctatatacatcatttatgaaacggtttgaggcccgtttggaccatacgccgctaatagcgccaaagtttcctttttcacttcccggatacagcatctttccgccattataaatgtccagcccgggagcactacggtaagacgcatgaatattcagaatatcagcgcccgcttctgccacggctttggataccggcatcagctttccgctctctgtatttaatttggcaatcaccggaatcttcactgactttctaacctctgacacaacagtcctgcaggaatccggatcagcgccaagattagcaccaagaaccgcctttgtctttgcatcagctgtcaataaattcgggcagttaaaattcagttcaattgcatctgctcccgcctgttccatcatatgggacagttctccccaggatgccacgttattgggagttccggacagattcaccgctattttaagcgatgtctgttccttggcctttctaatcatatctaaggtgtattcaggatccaagcgcggatccccacttacaattaccccaatcttgctatcgctgtaccatcttggctttgctgcaaatttttgccaggtcatggtgtgctttaagcttacggcggcaaatccgttttcatcagcctgttttaaatggtcaagtttagaactgatcggacctgaagcaatcattaacgggtttttcatttcaaaaccaccaacatcaatttttaacgaactcatctttaataacctcctccattgttgtcccattatacggtatagctgtcccatttatcaatatatcactttctttttactattgcaagatgttttttaaagtgttaaaaaaagacggttcatataaccgtctcagactgtaaacaaagtccagggcttgcaccctggattttgtctgttttaagatagaaaaatagcgaaaccttaattagggattcgggtcatcgaacacaggcgatagcgaagctgatactagatgatcaaatacagccgttgtttctgcattaaagaccaaagacgaaaagtagattttttaagaaatataaatatatatgataagtattatgattactatatttgcccaaatgatacaaaattttataatgaataatgacaaaatggagttagggcttgtgccctaactccaactttgtctacaggataaaacggttcatctctgtattttattgtcaccttttatcttaataatttaacgcttgcctcatccacagcttcctgaagcatttctatatacatttttttcacttcttccgagtaaaaagatatcacactgttgattgaaagggctcctattatctcttttgtaatcacactaatgattggaacagcaatggaccagcagccggtataaagctcctctttactaacggcatacccgtcctgacggcatttttcaattttttcaaggatctcttttttattcgctgcagtgatgatcccatttttttcactatattgaaaagcctcctcaaattttgaagaagaaagtgatgccgcaagcatacgccccgtagaaccaatgaaaagagggcctctgtcccccatatgcacattgctgatggcacgtttgtgcccctcagctctgtaaacgcagatacgctctatatcatttataacattcacagaaacggtttcctgggttttttccgaaatattcttgaccagcggaatcattacctccaggaaatctgtgttctgattgtaacttaagcataggagctgaagtttctgggagatggaataaccttgatcctgtacataaacaatcattcccgctttctccatactctgaagcgtcctgtgaactgtacttcttggaaatcctgtcagcttttggatcacgctcacgctgttgttcccttttgtctgtcctactgcctcaagtactgtaaaaatcttctctaccatattaaccatccgttctaaaaagttttggcacactcttttgctgtaccatcagtttctattatcatattattaatttacaaaaaaagcaatctattctgataccactcaaagttttataatgtaacttctgtgttttgtgaaatttgtatttttacacttgcatttttctaacttttttgttatgatcccactatacggtatagcagtcccactattcggtatagtgcaaataacatattttgatagtttaactatcactttttggaaaatgagaggagattacaatgaaattaaacattatgaaaaccatgcataaaatccccagtgggctattaattattcctttactgatatccgccgtatttaacacactctttcctacattctggaccacactgggagggcccagcgaaggtcttttcaaatctggtacatactgcgtcatcggacttatgctgttttccagcggtgctaccgtttccttttcgaaaataggtaagattttgaaatacggtgctacttatgccatatttaagctgcttatcattttcggtatcggaactctgtttctgcgcttttttggtgtggatgggatctggggtatctctgccttcgcttttattcccgccatctgctatatgaaccccggattatttatctcactggcacagcaatacggagagcctgaggatatcggcatgatgctgctcccacagcttttctgcatgtccgtctggtccatcctcgtattcaacctttccggcggctcggatgctgtcaactggatgtctgccattaatgtattgataccattctttcttggtatgctgctgggaaatctggatccggaatttattaaatttatcaagccggcttccaccatctgtctcgtgctgatgggctttgtatttggagccgctattaatttaaagactgctttccatgctggtatacgcgggattattctcgcactggttatatttgttatcaatctggtgtttatgtattttctagccgacaaagttatcttaaagagacccggctgggttggtgccggtctgtgtgctaccacaggagtcgcctgtgtggatccttctctcatggcggcaggcaatgaggcatacacagcatatgtaccagaagcggtttccttgcttgctctcacctttttgattacaaccctgatatccgccgttatgtgcagggtaatctcgaacaaatcgaaaagtacggaagctgatgggaacaaagaggcagcctaaccgatatatttcatgaaaataatcaaaaaggggcagtcgggtaatggtattttttaatccatttgtccccaaataagaacatcctcgcaggaatccacacttttcaggtgttcggttttccttcgggatgtttttatgctttctttgagaatcactcttcctgatgacttatttcggtacggatataggtaaggcttcttccattatgatattgataataatgtgtgtcttcttctatcatgtacatcatgttgtaatgctttccgatgtcttccttgtatgccttgattttcgtcttttcgtgcatctgcagcctgatgtagcttttaattccctgctcctttagataaatcatattcttttccctgcaatagccactgtctgcagttgtttgctttggatcgtgccaaaaaacccgttggtgtttttccaatacggtaatcaaggtattgtaattcgttcgttcactgctgatatagctatgaataataaaataattctccactgctatctgtacattataggctggcttgagcagcccgtttttcatgtggtcatccttcattctcataaaggtgacagctacatccatttttcaaatcttccacaacaccaaaggaaaaaaatttgcattgaatttgcaaagaaatatttttccctaaaagaaaaaaagcggacgctcacccagcatccgctctccaaccaattcaattttaacataacaaacaccagcaactccgcataaatccaaacaaaataaaagccccaaccccgcagctctctgtctgcaaaaccggaacttttgatgcgccttcggggctcgaaccccggacaaatagattaagagtctactgctctaccaactgagctaaaggcgcttgtctttcgtttctacactgtactctcgtcttgagcacgtgtgtaattatataaccgtatccaacaaaagtcaacaccttttttacaaataatttacaactttttcgaatttatttatttttcttatttttttgtatatttccgctcagggttttgttcacatctacaaaagatttgttccaggtcagcattttcttatttaattccgtcttatcactggtagcttgaagaagcttgcttgtgaccttgtctttcattcccataaccgctgctcccacaactgattttgttttattatatgcaaaaccggcattatggttatagaaaccaaacaccggttttaaaaaaatattatcttcttcctgctgtcaatttataaatgggattccccttggaggaaaatttctcttcatactctgtcatcacgttcccctctcccatctggctgtgatgaaggtcataggtaaattccttaacctgccagccggctctaggaatggattccagggagtaatcaaacaggcctttgttgtcggttttaaattccacagtgccgtcaggctttaaaatccggtcataaaccgccataaaatcctctgatgtgagcctgcgtttagcatgacggtcctttggccaaggatcagaaaagtttaagtacaccctctgtacctctccgagggcaaatatatcacccaggttttttgcatccacgcacataaagaatatattatcaagctccatctgagcccgcttctgcaaacccctcaaaagaacgctgggatatctctcaatgcccacataattgatttccgggttcatggcggccagctccatgataaaacggcccttacccatgccaacctctatttcaataggattttcattgccaaacacttccttccagcagccttttttatcaaaaggattctggacaacatacggactgttcgcaatctcctcttccgagccttgtatatgacgcaacctcatcttaaaattcctccaaataaattcatcttaatgaaaacatacattgcctgatcgattgtatcatacatggtacagggaacgcaagtttgccgtttatttttccgcctccagcctgataattttacaggctctgccgctgtctccggatcatcctgaatgtatctgagtaagcacagatcaagctgctgcacttccctttcacaaactgttcacatcttccacaacttttctacacaacagcccggtatattaatacttgttacaggtaatatccttataaataaacttttttcatattgccggcaggattcctccaatcttgccggcacctctcctttatgaggagattaacggttcttatgtcatttatatcccttctgatttctaatcgcttccgacaatgtctgcataaaccctattaatttaaccccacagacccattttcctgttttttttacttttctcttacgaagcccatcatattttagccacgacaccccctgtttttacagcaattctaaagataattcgcataaaaacaaatgttttatactgtttatatgttttttttgtatcataatagtatcacgactttatgtaatgggctggcccgaaataacggttactcgcagcaatttgttgataaaagtagagttaatgctgacgaaactgaaacatacttggggaatggggataaaatgcaatctgacacctacctatattctttgccgcaatcacccttattttttgtaaagattcctttacttgtaatattttaaaagtaagtataatataataaaaaaggcaatcgccacagggtggttggctaattagaaaagcaaaaaccttcccaaccggccaaagtacagggaaggttttttgtatttagcgacacgtcaataagacgaatgtcagcagtgccagaaagaacatgccaaaagacattaaatccttaaagtcaaaatacttcatgagcaacacctccattctatgtagaatcgaggcctaccatcctatacacgattgccagcagtttgtacctgccagtataattatatgttccaacttaagactgtactattaataatatcttacaaattccattgggaccctattcatccagccctggatactgcagcgctccatcctgatccaagtaataccactttccgccagaagattgcaggcccttcaccatggctccatcagctccttggtcagttcaatagctgcctgcaccgtagcctcctcaaaataccaatccctgattgcatccgcctccaacagtaccatagtttatcgtaatttgggcagtttcaaatgaaatataagattctcctacaaaacctgctttatttgctccccggatatatagttcatttgccccaccaacatattcttcccatgttaccgtaatccagggccttctgccatttcttcttgtccccgcagccgtggtcacttccaggaactctaccggaccatctcattttagaaaggttttatacttctctgacagaagcaggcgctcatcactcattatccatcaccgcggcgcatctgcttaatcaaatcatcaagcttcgttttctcagtctccagaatgccagacacttccagcttatccttaaacatacctaagtgcctgccaatcagttccagggctttttccttattattcagtttaatttctatctcattggcaccttccttgattccggcaatgacccctaacttatcccttagcatttcatctggggattttatctgcactgctttatagcttcctttgctttcaatcgtcacaaagtcagtaatatctgcgaaaccgatcttagcaagctcctttaaaaccatgtcctgggtgatctcagtacgtttttcccggtccttcattcgcttttcaacataagccgcaacgttaacattggttaacattctgcttgcagccgctttggctgtttcatctttcttgaccttggtatatgctgccttgtaaggcctggtgacattaaggtcaatcaggtactcatctgcaaataatttctgtttggctgacaacgccatctggctcacttcctttcaatttgtgcataacaagcgactaaaaccctgtaataatttgcagttttgtgtcgtattttcagatattaacactcaatccacaattgtttccacaacattgtggataagtgtcgttttgggtattaaaaagagacggggttgaccgcctcctgtttactcttcaacatgtacgttcaaatataactttctctaacaaggacattaacctcacactcgcgaattatttcttcaggcataccagactgccataagcattcctggaacgcttccgctactctttcatctgccaatgcaactgcattttgaatgtttgtcatacatgcatcattgatattcaaaaacttatcaccgccatgatcaaaacgacgttattacatctcccaaaacagcaggcggtacaagacttgtaaccatacctccatttctcacagaatgtctgaaagagtacatagataagaattatggagtaaaagctgaggataggcttttcaattttcccggtataaattaggaatttgcttaaaaggcgcctgcgcatcttccggaattaaaccaatacgcattcatgacatccgccacagccatgtttccctattaatagatatgggcttctctccttatcttatagcagagcgcataggtgattcagtggatatggtaaacaatatttatggacatttatatcccaataagcacagcgaggtcgcaaacaaattacaggatttagtatcaaagtagtatcacagataactttaaaatacaggaattcctttattttatagggaatccctgtatattttttacttttctcttacaaatcaaaaaacgacaaaataacaggtgcgcaatttacaataatctagtataatatctgtatattggaatacaaccgtctttgcaaaggaggaaatatatgggaactacagacaacagtttcttgaccagaatccagcagggtctgagggaagcggaaaggctcatgaaccagaagcagtataacatggccatgatcaaagcccggcagaccctggaatatatggtaaattatcttggtgaaagggctttgatcgtggagggtgatctggcggacagcatagaccagctatttgagaggcgctttatttcccagtcagccaaagaccactatcacaggatccgcgtgctgggaaacaaggcagttcatgaaggagacgacagcccttatgatgccagcgaagcctttcagcttctgtctcaggaagtcaatgcctttgcaaactctttcaatagaggaagccagggggagcccctgtcagtaagcggcccgcagacgtcaggaccatgtcatcatccacgtccaggaataatcccccccgaagcggtgccttaaggaatgaagcctatggaacaggaaatccaagaagcaccggtgcaagaaccgcgcctttaagaacccaggagcatatcggagggacaaggagcagcgggacgagaccggatggccaaagacccggtcagaggccgccccaaaggaatgcttccagaaccggccaaaggcctgcttcacacagcagaagcaggaggcgtaccaggaagaacagctttgatgtctacggactgctgaaaccagctcttattttcctggttcttcttgtgctcgtcttaatcatcgtgaagctgatcccgggaaaagactcaaaaaacgagcctaccacaaccccaacatctgctgaggtcactaccgaagccatgacaagcgccgaaacacctacaacagctgcggagccggaaacagaagctcctaaggtctacaccaccatgagcaagcttaatgtccgttccgagccatccaccaacggagccaagcttggaacccttgcttccggtactgtggtggattatgtcaagacctatgatgacaaatggacggtcatcatgtttgaaggaacagaggcttatgttgccaccgaattcctgaccgtaacggaaggcgaatcggaagcgggcgcagaggaatctacctctgccgctgagggtaccacagccgctgccccgtaaagaaaacgttaaaaaagcgaagaatccagggataattttcccttggtcttcgctttttctattgttcatgcataaccccagctttggcggcgtaacttatatttatgataaaatttcattaatattgtcgtttttctctaacagactatggcattttttttaaattgtagtatcattataaattaagcactatttttttcaacgaatgcttacgaaaaggagggtacagtatggatactgtaatcgagaaaatatccgagattgaatcggctgcggcttccattatgaatgatgccaatgagcgcaaaaaggcctttgcaaaagaaatggaagagaggacggctgcgttcgatgcacagctggaagcggaaaccaacaaaaagattgaagagctgcaggccgccatggaaatcagcatgaataaccgtctggaaaaacagcggagtgatgcccaaaggatccttaaagccatggaacagcattacgaggaccatcatactcaatatgtggaggagttatttaatacaatgacaaaggagtgatcttatgggagacttattatcctacagcggcattacaaccaaggtaagagccatggaaagccatctgatcaccgacagccagtttcgcgaaatggcagcccttgaaactgtttctgatgcagtggaatatttaaggcgcttgcctgcctatgaagggctgtttgcaaacttagagggcgtggtccttcacaggggagccattgaacagcggctgatcctttccctgtaccaggattttgccaagctctaccggttcgccaatttgacccagcgtaaatttctggacttatattttatgcactttgaaatcgatatcctgaagaaatgcttccgcaatgctatggggcggaaccggccggatatcgatctctctgtattccaggacttttttgagaagcattcccggctggacttaatgaggctgtcttcctcaggagacttgcatgaattcattacaaacctggaaggctcggtttactatgacctgctttcccacttagacgataaggaacagcccgccttgtttgattatgaggtccacttagaccttctttactttaagaccatctggaaggtcatgggcaaatatcttaccagaaaagaacaggagcttcttatacgctgctttggcagcaagctggatttacttaatgtccagtggatttaccgctccaaaaaatattaccgcctgcagcctgccgatatttattcccttctcatccctattaattaccatttaaataaggagcagatcacaaaaatggcagaggcagccacgttggaagagttttattctgttctaaggaccaccttttatgggcggaaatccgatttggaagccgcggacatgccggacttagaacaactgactcaggaaatgctggacaaaatataccgttccaccagccggcagaatccctattccattgccacgctgaattcctatctttattttaaggaggaagaaattcaaaagattatcaccctcatagagagcatccggtacagcgtaagctcggatgaaattatctcctatgttgtaaaaaagtaaagggggttgcttttccgtgatagaaaagatgaaattcttaagtatcaccggacccaaggaagatattgaccgggtcatcgacacctatttatccaaatatgaaatccatttggaaaatgccctgtcggaattaaaaacggtaaaagacttaagaccttatattgaaaccaatccatacaaggacgcgtaccagcgcgccatggaactggcggaattactcccgccgggagatccggcaaacagccggaaaaaagtttccattgagcgggccgctgaaattgttgcagggatcggagaacaggtaaaggaactgactgcaaaggaagaggcccttgtgaccgagcaaaattccttccgccaatccctggaccggatccttccgttcaccggacttaactatgatttaagctccatcctccattttaagtacattaaattccgttttgggcgtatttctcatgagtattacaacaaatttgagagctacgtatatgataccattgatactgtcctttataaatgccgggaggatgacgagtatgtctggctggtttattttgcaccggaaaccatctcaaaccagattgatgccattttctcttccatgcattttgaacgcttctttttgcctgatgaatacgagggcacgcccctggacgccatccattttctggaagataagatcaataccctgcaggctgctattaacagcatccgaaagcagatgtctgatcttctggcggcaaggcaggaggacttatcaagcgcatatagaagtctggaaatattttcaaccaactttaatgtgagaaagctggcagcatgtaccaagcagaatgtaaacaccttttacattatctgcggttggatgagtaaccgggatgccgctgcttttcagaaggagatctcagacgataaaaagaccttctgcttcatggaggatgaccataacaacattatgagcaagcctccaaccaagcttcacaacccaaagctttttaagccttttgaaatgttcatacagatgtacggccttccggagtacaatgagatcgaccccaccatattgatcggcatcacctattccttcctctttggttttatgtttggggatgtgggacagggaatgtgccttctgtttggagggcttctcctttaccggcttaagaaaatgaatctggcggccattttatcctgctgcggcttcttctcaaccatattcggattccttttcggcagctttttcgggttcgaagatgttataagcgccgtctggctccgccccatggagcacatgaccagcctgccctttatcgggaagctgaataccgtatttatcgcagcgatttccattggcatgggaattatcctgatgaccatggtattaaacatcataaacagcatccgttttcatgacccggaaaaaaccctgtttgacacaaacggtacggcaggacttgtgttctatgcaagccttgtgctcaccattgtcctttacatgaccaaaaaccctgttccggctgccatactccttgtgatcatgtttggcatcccgctggctgtcatgttctttaaggaacctctcacaaacctggtggaaagaaaagcccagatcatgccaaaggaaaagggcatgtttgtggttcagggctttttcgaactgtttgaagtgcttttaagctacttttccaacaccctttcctttgtccgtgtaggagcctttgccgtcagccacgcagccatgatggaagtggtgctcatgctctccggtgcggaagcaggaaatcccaactggctggttgtgattctgggcaacttattcgtttgcggcatggaaggcctgatcgtgggaatccaggttctgcgtctggaatattatgaattattcagccgtttctatcggggaaccggccgggaatttaaaccatacggaaagaaaaattaaaaaccaaaatggaggtaatattatgtcaatcttagtaaaaataacattagcaatcgcattgaccttaagcatcgttgtcccctttggtgcttttgccttgggtgaaaaaacaaaaggacggtataaaaccgcactgggcattaacgcacttttatttttcggtaccctgatcgtttccagtgtattcatgtttaacggccaggctgccgcagcagaggcagcaaaccctggcacaggaagcattgcaggaatgggctacttagctgccgcactttccacgggacttgcctgtatcggcggcggtattgccgtttccgcggctgccagcgctgctttaggcgccatcagcgaggatggctccatacttggtaaatcactgatcttcgtagggcttgccgaaggcgtttgtctgtatggtctgatcatttctttcatgatcttaggaaagctgtaacccatgaaaatgtatttgatcagcgacaacgtggatacctggaccggaatgaggttagccggagtggaaggcgctgtcgttcatgaaaagacggaactgaaacgtgaactggataaagtcctggccgataaagagatcgggatcattctcctgacggagaaattcggaaaagagtttccggatatcatcaatgatgtgaagctgaaccgtaagctcccattgatcgtggagatccccgaccgccatggtaccggccgcaagccgaactttatcacggattacgtgaatgaagccatcggattaaaactataagaaagaggtggtcatcttgacaactgaggaaaaattacagcatttcctggaattttgtatggaagatgccagaacccgcagtgcaaagatgcttgatgaatatacggcagccttagagcagaccttttcggagcatcaggaggatgccaggcgaagggccggccagcaggtaaacctggaaagtgaacggatcgaacgggagatcaacaaaaagctttccctggagcagatcggaatgaagcgggcctttggaaaaaaacaggatgagctgaaagataagctgttttcggagcttcgggataaactggccacattcatggaatctccgggatacacaaagcttttggaaaagcagatcaaggaagccaaggccctggcaggaaaagaattcatcaccatttacattgatcctgcggatgaagataagatcaatgaactgtcaattgccggcggctccgatatccgggtgagcgaatactcctttctgggaggaacccgggctgtcatcccttccaggcatattttaatcgacaattcctttcaaacaaaattgacagaagcaaaacgggacttccgctttgatgtaaaggatctgattggaggtacggccaatgactaatacaggtactatttccggtattaacggccctgtcatttatttgaagggcgattccggattccgaatgaatgaaatggtctatgtaggcaaagaccatttagtcggcgaggtcatcggccttacggaccgccgcaccattgtccaggtgtacgaggaaaccagcggcttaaagccgggagaaacggtctcctcctccggcttccccgtatcggtcacacttgctccgggcattttaaataacatttttgacggaattgaacggcctttaagcgagatcgcaaagaccggaggcgcatacattgaccggggtattcatgtggactcccttgacggttcaaaactatggaagactcacatgactgtaaagaagggtgatcatttattccccggaaccatcattgccgaggttcctgaaacccctgccattgtccataaggtcatgattcctcctgatatggaaggctatgtccttgacgccgtggaggatggttcctataccatttctgatcccctgctgacccttcagctgacagacggttctgaagccaagatcaccatgacccagaagtggcccatccgcgttccaaggcccatattgaaaaggtacccggcttccaagccccttatcaccgggcagaggatcattgacaccctgttccctcttgcaaagggtggcactgcctgtattcccggcggctttggcacgggaaaaaccatgacccagcaccagatcgccaagtggtctgatgcggatatcatcatctacatcggctgcggagagcggggaaacgagatgacccaggtgcttgaggaattttcccagctggtggatccacgttccggaaatcctctgatggaccggaccaccctcattgccaatacctccaacatgcctgttgcagcccgtgaagcaagcctttactccggccttacccttgcggaatattaccgggacatggggtatcacgtggccatcatggcggactccacttcccgttgggccgaggccttaagggaattgtccggacgtctggaagaaatgcctgcggaggaaggcttcccggcctatctggcttcccgcttatcagccttctatgaaagagccggaatcatgcagaacatgaacggaaccgaaggctcagtcaccattatcggggccgtatctcctcagggaggcgatttctccgagcctgtgacccagaacaccaaacgttttgtacgctgcttttggggcctggaccggaatctggcaaacgaacgccattttccggctatccactggctcagcagctattccgaatatttaaccgacttagccccctggtatgtggaaaacgtggataagaaattcgtggactacagaaaccgcctggtctttcttctgacccaggaaagcagccttatggagatcgtaaaactcatcggcggagacatgcttcccgatgaccagaagcttatactggaaatctccaaggtgatcaggatcggatttttacagcagaacgcatttcacaaggatgatacttgtgttccaatggaaaagcagtttaaaatgatggacttaatcctttatttattcaagaaatcccgttccctggtttccatgggaatgcctatgtccgtactaaaggaagatccgattttcgataagatcatttccattaaatatgatgtacctaacgacagactggatatgtttgatgactacaaaaagcaggtagatgccttctatgaatctgtcatcgaacgcaacgcatagggaggaggcagactatggcaatcgaatatttaggactaagtgcgatcaacgggcccctggtggttttggaaggcgtccagaatgctgctttcgacgaaatcgtggaaatgaccgtagaaaaaaagacaaagaagcttggacgcatcattgaggtttacgaggataaagccatcatccaggtatttgaagggactgatgggcttgccttaagaaatgttcacacccgcctcaccgggcaccctatggagcttgccgtttccgaagacatgttaggacgcacctttaacggaatcggagagcctattgacggacttggagacatcagctctgacattcgcctggatattaacggaaaacccttaaatcctgttaccagggaatacccaagggattatatccgcacgggaatctcagccattgacggactgatgaccttaatccgcggacaaaagcttcccatcttctcaggaaacggccttccccacgatgaactggcggctcagatcgtacagcaggcttccttaggggatgatgccctttccagtgaacaatttgctgtggtatttgcagctatgggggtgaaatacgatgtggctgattttttccgccgcacctttgaagaaagcggtgtttccgaccacgtagccatgttcatcaatctggcaaacgatcctgtggtggaacgtctgatcacgccaaaggtggccctgaccctggcagaatacttagcctttgaaaaggggatgcacattctggttattttgaccgatatgaccgcctatgcagaggccctccgtgaggtttcctcctcaaaaggagaaatcccttccagaaagggctatcccggctatttgtacagcgagctggcttccctttatgagcgggccggcattgtaaaggaccggcatggttccgtgacccagatccctatcctgaccatgccaaacgacgacatcacccatcccattccagaccttacgggatatatcacagaggggcagatcgttctggaccgcagtttatacggccagtcggtttatccgccgatcaatgtcctcccttccttaagccgtctgatgaaggacggcattggagaaggctttacaagggcagaccatcaaggtctggcaaaccagctcttctcctgttatgcaaaggttggggatgcaagagcactggcatcggtcatcggagaagatgaactctctcccattgataaaaaatatctggtgttcggaaaagaatttgaaaaccgttttgtagggcagggaaaccatgccaaccggaacatcattgaaaccctgaccattggctgggagcttctggggcttctcccaagatctgagctggaccgcatcgacaccaaggtcttagaccagtattacaagccaaccacccttgacgcaccggaagaataggagggatattcatgaatcccaatacatttcccaccaaggggaatttgatccttgccaaaagctccctgactttagccagacagggctacgagctgatggataaaaaacggaatatcctcatcaaggagctgatgagcctgatcgatgaagcaaagggcatccagtcggaaatcgacgtcacctttacttccgcatacaaggccctgcaaaaagccaacattgagctggggatcaattatgtgcaggacatcgccctggcagttcccgtggacaattctgtgcgaatcaagaccaggagcatcatgggaacagagattcctctggtcgaacatgatgaaatgcccttaaacctgacttatgcctattacagcaccagggaatcactggatgaagcacgttaccagtttgaaaaggtaaaaaagctgacagtaaagctttccatggtggagaactccgcctaccgtctggcaaacagtattaagagaactcagaaacgggccaatgccttaaagaacattacgatccccaggtatgaggttctgacaaagaacatcaccaattcactggaagaaaaagacagggaagagtttaccaggcttaaggtgatcaaaaggaataagaatggagtttagcggcaggttccaaaagccgtgcaataaatttaatatcagaatttttataagccataaggatcggagacggaaacggcagcagtcagttttccgcccccggtcctttgttttcatgtttttaaaataaaatctataaatagtgaaccaaataaaactttgatgactcttattatcagatgcatcgaaaaaaggaaaggaaacaggttatgatggaagaaaagaaggctttggtggaaagcatgatcaatggcagcgaagcagcatttgacgaactataccgttcctattccggaaagctataccgtatggcgtattttattaccggcaaccaaagtgacagtgaggacattttacaggagacctttgttaaatgctttcttcataagtcaaaactgaaacaaggggaacgctttgagtcttggctgtatcaaattcttgtcaggactgcctggcggcttgaacgaaagaaaaaagggagggctgaaatctcttatgaaggtattttagaaaatgaggaagaaaaaaagagcgcggaacacatccgggaagataagaaagcagatggacctttggaatctgttttagaggcagagacagcaaaagaaatccaggcggcactcatccatctggatattaaataccgtactgtgattcttctgtactattataatgaattgagcaccagagagattgcccacattacaggaaccatggaagggacggtaaaatcccgtctgcataaggcacggaaactgctgaaggatttattgaaagctgacggcactgaaaaaacagaaagggaaaggggcatttgccatggataactttagggatgacagattaaaacaaatcataaagactgggctggatcagataagcccggatgtgcagacagagaatcgttgtcttagagaaattcataaaaaaatagaaatgaggaatggaattatgaaatttaataaaaaaagaatggtggcagcattggctgcagtgtgtacaataacggtaatgggaactgtcacggcaattgcaggcggtaaaattacaggtctgtttagctctgtatcccgggatgatatggtccattcaaaagctgaactggtccaattagctgagaaccagatgagaaccgctccaaagctggtagatactttttcaaatggcatttcctttaacgaaggttctattactaagatagaaggaagggatttaaaccaaaatccaatgcttacctacccggaactctatgccggatatggggacaatgatcgtgtggcacttcacgttcatgaacatcaggatatgattcctcagggttcttctacggtgataaagcaggaagtctatcaggatatcacattagaagtccacgaagataattacctgtttttacctccagatgcaaaaccatcagaggacgatttgaaactggaggaagaaggccagctgatgatcagctacggaagcagcgaagaagagcgtaaggtatatcgttatgtaaactggagtgaaaatggtatggaatatttgctcagttcctttgatgatttgagctgcgatgatttaatcggtatggcgaaggaagttatagacgtaaagtaaaagagacagcagctaatctgcaaaaactgaagtactaagaggctggagatatgcttctcagtacttcagatttttttagccatactgatactgccctctgaacactgatatgttctcttaaatttctgcctttcggatacgtatagattcataatcgcagtaaccttccgattccgcattctcccgggcgcacgcccacaaacaaggcttggctcccgtccaagtggtccggcaaagcttaaataaagggtctgtctccagaaattcttcaccatcccaggaataggagaagcgatacgtcttatcctccaacacatgaagcttcagccatattctatttccatttcctatcagctttaacacgcactcctcgtttgcttttcctttgaacatcttgtctgtaacagttcctttgtagcatcttagttctgtcccatcctccgtctgatataatcccatgtaggaatagaagtgccctatcataccgatccctccgaaatcacctgtcgttcttccgtgtaatacaagcttggccgtcatagtaaaagacttgctctgcggaatctgagttagcgcattcggtgcataccacaaaagattatctcttgtaggatgtttccggcaatacagccgcagaaagcccggattggcagtaagagaataatgattgggatttgggtttgcctgccactgccattggagaccaagtctctcagactcaaactcatccgattgaaggatttcatattcaggcatgtactccacaggcattcgccactcttctaccggttctccaattccatcaccatctttatcctgaccgataaatggccagcctttaaaaaagcacatgggctccagatgtaaaattcttcccagctcatttacatcctggaaatgaataaaccaatcatgcccgtcaggagatgtggtccagccgccttgatgagggccattaattttagaattaccctgccgcataacaaccctgtactcataggggccccaaatatcccttgatctcagacatgactgccagccgttttccacacctcctgagggcattagtatgtaataatatccattctttttatacagcttcggcccctcagttgtaggcgctatctgttccccgtcgaaaatcatctgaggttctcccaccagatacttacagtctgtattaatctctgccagcatcagacgatgtttgattccagccctgctgcctgcatatgcaaacaccatataggctttcccagcctcatcccaaaacggacaggggtctatccagcccttcctttcacataacatatttaattgaaattcaccataaggattatcacttctggcaaccaggataccctcatccaccaaaggaataaatacgaaaaatgttccttcatgataacggatggaaggagcccacgttcctgaaccatgggaaggttccttatatttctcaaatggaagcgcttttacacagtaattaatgatttcccagtgtaccagatccttagagtgaagaagcggaactcccggaacataggtaaatgatgatgctaccatatagtaatcgctcccgactcggatcacatccgggtcggaataatctgcatataatactggatttttataagtcttcatgattcctccatagttacgtcctgctatttttctaacactaccccttcataccagttgtggcaatcccttccacgaaatatttctgtgctgcaaaaaataaaatgatcagcggtattacagagaccaaagccatggacatcacctgattccatctgatattggaagttacatcaatactgactctcagcgccagggataatgggaatttagccaccgtattaatgtaaatatttgtattaaagaaatcattccaggtccataaaaactggaacagtccggcagaaaagagcgccggtttcaaaagaggcagcaaaattctgataaaacactggaacggtccgcagccatcaatataagcagattcatctaagtctctgggaagtccccttaagaactgtaccatcataaagacaaagaagggatagcagcctacggctgccggtgcaaaaaatgtcatgtaggaatccagccagcctaacttattaaacagtgcatatctcggtataatgattactgcattgggaagcatcagcgtcgcaatcagtatcatgaaaaggaactggtttcccggaaaatcaaatctggcaaagccataggccaccagtgaacatgacaccagagtcagcagggtggtagggataaccagggcaaaagtgttgataaaatactttgcataggtataggtacccgttgttttccagcccttaataaatgcttccgggctccagctctccggaagcagagtcaggctgccgaatatttcattattggacttaaagcaagcgaaaaacatccagattaccggaaacagcatgacaacaccaaatattcccaggagcacatatgtaattccattgttgatttttttgtctttcattcggtctctccttcctagttatcataatagacccatttttttgatgttacaaaaagaatcagggtcataatcataatgatgataaacaaaatccaggatgtggcacaggcataacccatcttaaaatacttaaatgcatccgtatataatttcatacccaacacgtaggtggccttgttaggcccgccatttgtcactacaaaggccgatgtaaaattctgtagagctgtaatcagctgcatgataatattgaaaaatgcaatggaggtaatcatcggtaacgttatcttaataaagatcctgatctttgtggctccatctatcctggccgcttcataaagctccctcggcacctgctttaaggcagataaaaacagtaccatggaagagccaaactgccagatctccagcatacagatagtgatcaccgccataccgggattgcccatccattttacaggcggtatatgtacgacacccaacaggctgttgataaagccgtcgttcatgaaaagcaccttccacaagatcgcaaccgctacggaaccgcttaaaagggaaggaatataatacacagttctcataaagttgatccctttcaattccctgttcaggatcatggcgataatcaaagccagaatcacctttccaggaactgtaataaaggtatattttaaggtaactgtcagggaattccaaaactccttatcttttgtaaatagcctgatatagttatctaaacctatgaaggcaggcttatcaaagatatcatagtccgtaaaggaatagatcagagaactgataaaggggtacatctgaaataaaaggaatccaaaaatccagatgcatacatacataaaaccaatcctgtttcttttggtccatccgccgcaattgtgctttgctttgaccttactattaaccattaatttaatcctcctgccttttaaaaaggactgccgtaaaatgaaagttcatttcccggcagcccattatgtactcttattttaaaccgcttaagtaatcattgatcaaatcaatcgcattatcggcagcatcttccggtgtactctgtccataagcaacactttcaatcatatcttcctgaatggcataaacttccgcactggtagtataccccttgtcactcttgccatttaaccctgctgccagatctaccgcacttacaacaaccggatttaacagtttcttatctgcgcagaggcttctggctgtagaggtcggcggcacgcttctgacgtcttttaatgtctcctgagcttccggattgttatagaaataatccaggaatctcactgcttcctccgcatgcttggagttcttgtttactgtcatgtactggggcgtgtctgcaaagaaaccgtcattaaccctttctgcggacaagggcatctgcactaccgtacatgtgttatccggaacagcatcaatcagcagattgatactggaagaaggaccataagcaaatacaaattttccgtccatccacataggattggtttgaatctgccccttaaaggtcgcactgtcttctgcaggttcaaaaacaccggcctcatagcagtctttaatatattgaagcacttccaccagctgttctcttgtaaagcttatctttttttcgctgtcaatgataaaggactgacctgttaactgacgaagatatggtcttaatacatattcacacaaaattctggtatccgtattcatatagaaatactcagggttctgttcatgaagctttttcccgtcttccagcattgattcccaggtaatctgcttgcttaaatcaattccgcaggttttcgctgcatcttcattagccacggtggccagacaggacatcccagtgggaatggccagaagcttgccgtcaaaggttccgaactggctgataaatgatgtttcaaaacctgaagtatcaaataaatcagggtaatcattaaagtttacgaagaaatcgcctctggatataaaatcagggagggagtccacgttctgctgcatgatatccggtgcagtaccgttggccagcatggtggataccttatcaatataaccctggtcggaattcatctctgcctcaatctttacttccggatgaaggttctgatattggtcaatcactgccaatgtcgcctcatttctggcgtcaccgccccaccacatgaagcggagtgttatctgttctgcagatgactttcctgctgttgtctgatccgctgccttttctgtctctgctccggaagacatggctaccggtttattcgtgcagcccgtcagggcggttgctgccatcattcctgttagaagcaggcatgtcagtttcgtcacttttctcataatctttacctccgtttgcttttcactgaatcattaactatgattattgtaactgaagttttataaaatagtaagaaacttgcatgatagaatcgtatcattctttacaaatttttctgccaaagtatcattatgaactaaatttcttcattttcaacgatcccgccaattctttaaaaataaaagatgcttttttattttttttctttataataaaatcagatcttttgtgaagggagtgttcattatgtatcaagtgatcatcgttgatgatgaagccaagatccgcagcggcctcgtaaacctgtttccctggaaccaactgggctttgaagtagccggctgcttcgccaatggaaaggaagcctatgaattcatactgggaaatcacgtcgatctgattctttccgacatccggatgcccattatggatggactggaactgtcagaaaagctttcttcaaagaggaaggtcaggattatttttttcagcggataccaggatttcgactatgtcagacgggctctgcgcagcggcgccattgactatcttttaaagccggtcaaatatgaagatctggtagattgccttacaaaaatcagagaaaacctcaatatagaaaatcatcggtctactgcaccggaagaagagaatttgagctactatgaaaagcttatcggcatggttaagaattatctggatacggattatcagaatgccacgctggaacaagcagccagacttgtggaattaagccccaattacttatcaaaggtcatgaaggaacactccgatttaagcttttccaattatctgctgaagactcgtatggataatgcagccaggatgctgaaggatgtcggttataagcaatatgagattgcttaccgggtggggtatgataatcctaagaatttctcaagagcttttcatcagtatttccatatgacgccatcgcagtaccggcagaaccactgccccctcgcggagaatgacatgagaaaacggaattttatcaagcggttcttatattatacaggtatcatcacgctacccatcattacagtttttatgatctttctcgctgtcattgtatatggaaagcaaaaagatatagaagccgaagccatcaaatcagcccaggccgtcagagacagctattccctcgttcttgacagtgctgctacccaatatgatatgctggtccgaaatcccaggatgtccatttcgctgcgcaattttatatctcataagcagcttggttacatggatgtgatcctcactaacagtatcttctccaattttgcctctctgaccagtaatgcttcttatatatcctcggtatattattatctggatggatatgattccctccttacctcatataccggagggattgcccagttgtcacaattttccgacttaaactggatggaatcctataaaacctctgacaaaagcgaatggattgaaaaacggaatatgactttatattcctacagccggcctacccctgttctgacttattataggaaactcagcatgttccagggagtcattctggtcaatatctatgaagagcagttaaggcagcttctcaattccggttctaatctggaccagttttttatcattgactcacagggcaactttcttttacagggaaacggaaacatgcaggaactaaacgaccacgacagggaagccatcgtatctatggtaatggcttcttctgaccagccctgccaggactggatatcttttaaccaccagaactattatgtcagagtcataccggccgcatgcggtacttatattgccgcatgcaccagtaagtctaattactatctggcgctgtacacgcttcttttccagttacttatggttctggcagtggtggtatgcacaatggtctggattgcttataccattaccaagaagaactttcagcagatcgattactttgttactgtattttccgatgcagaacggggtacttacaatcaggagaaaccaagcttcatcaaggatgaatacgatattattttaaataatatcgtccggctatttgttaatcagaccttcctgaaaaatcagctgacattaaagaagcaggaacaaaagctggcggaaatggctgctctacagcttcaaatcaatcctcattttctctttaataccttgcagacactggattttaaggccattgaatttaccggtaaacctacgtctctgaacaatatcattgaagcactctccgatattctcaaatattcgcttcaaactaccacctccatggtaaccatcagggatgaggttgaatatctgaaaaaatatgacagtatccagagataccggtatgaggataaatacattctgtactacgattatgacaaggcagtggaatcttaccccctcatgcggctcatccttcagccacttattgaaaacagcctgtatcatggcatcaagccccttccaggctcaggctttatcaaactcaaaatatcggagaaagatcaatggcttaccattaccgtaatcgatacaggtgttggaatgagcaaagaagaagtggctgccctcaatgagaaaatcaatcaccccaatcaggaaaacatcggcctgtccaatgttaacagccgcctggtaatgcaatatggaaacacttctcaattaaaaatacttagtaaaaaacatatgggaacctgtatatcattcaaaatcccgctataccggcaaaattaaatggtttattgcaaaactaaaacaaacaggatccaagaagggaacaacatatgatgtgttccccgtctccgatcctttcttacatatctctcttaagcatttaaaaccagtcagaactatcctcaccgcgccatcaaggtaaataccctggcttcattgtccgccttgatcaccggcataggcagtcccgcatacatcagcgctgctccggaaagctttatgccaagctccagaatctcatactttgtctgttcctcaagccccttaagccttaagtaaataatccccttattggctccggaaaccctctgtacatatcctacgaccgcctctttcttatcttgggagaccgacataaacgccccatactcccgctctctttccgggttagtcagccggtaatagtctccatgggcggacaccagcccgtgttcctgataatattttacctgcctgcggaccgcttcctgttcttcctctgatatttcatttaaatccagctcgtacccaaaggtcccaaaataggcaagagccgctcttgtgtcaatggaaaccgttcttcccgtctgctggttggggcattccgaaacatgggaacccatggcaaaaggcggatagatcatggaagttccgtactgaatgcgaatcctctccaccgcatctgtatcatcagagcaccagatctggggcatgtagtaaaggacacccatatcaaaccttcctccgcctccgctgcagccctcaaaccgcacgtttggaaacgcctttgtcatcttatccatcagcttataaagtcccagcacatacttatggcaaacctctccctgcctgtgggccggaagagcccctgagaaacggtccgtcatgctccggttcatatcccacttaatgtaatcaatctgtgcatccttaaattcctcataaagctgatgaaaaatagcattcaccacttcatccctgctgaaatccaggatcagctgatatctttggcgggttggttttcttcccggaatctggatacaccagtccggatgctcctcataaagcctggaatcctcattgaccatttccggctcgatccagatgccgaattttaatcccatatcatgaattctttctgaaaatcccggaattccgctgggcagtttcttccggttgcactgccagtctccaagccccctgtattcatcggtccttcttccgaaccagccgtcatccatgacaaacatctcaacgcccagttcctttgctttacctgcaatattcaccagcatttcttcatcaaaatcaatcatggtcgcctcccagttattgatgagaaccgggcatctttcattgacaaactggccgggaatcagatgatgcttcacagcccggtggaaattgtggctcattatggaaagtccctgaaaactataggtcatgactgcttccggcgtttcaaatgcactgccctttgtaagctcccagtacagcgtctccggattcactcctgccaccagcctggtctgcttaaaatcgttgacctccgttgtgatcgcaaagtttccgctgtaaaccagggcaactccatagcaatctcccccatcctctgttgcatccggactgcagagaatggccgaaggattctggtaatggctggaaatgcctctggcactgtccaccgtaatcttcccatgtctcacagatgttctctccgcacaccgctcatggccccagcttccatagaagctgatcatatccatctgatccgtcgggaaagaaatgcaggtggaatgagctgcattgacaaatacggtctgctctcccccattctcaatcctggcacatcttgtaatgatgtcatactcctccagcacgccgtaaacaagagtcacctccaacagagtgtaagggtccctcatcaagacctccagggtctgccatgtgccgccgttgtcccgcagggaaggcattccttgcaggctgtattttccattaatcaccttatgagacacatatcttaaatcaatacagtcagacccatccccgttaattacgctgactgcggaaacgcggaagtctgaaactccaaacccgggatactcctgttccagcacatccaagcagatggtcctgtccttttccgactcatagggattggcctcgaacccatggcggattctcaccgggagataatccgctgtatcggaaatctttcttccatagtataaatgctctaaaaacccaaactccgccacccggaactggtagcttgtatgtttcgtgttcagcaagaatacctttttatcctcaatatattgtacactcataacaaacctcaatctttcaataattttagaaagaaagcggaattctcatctgattcccgctttcctttttgaatcatatttaattattttccaattacttaattgcgctgtccaccatgccctggataaagtatttctgtaaaaacaggaacaccacaaccatgggaagaatcccgataaaggcagccgccgccgcaccgttgacattggccgagtccgcggaaaagaagcctgcaatggccagggtgatggttttgatcctgggtgactggagtaagtatagggcgaactggtaattgttccagcagtttacgcctgtgatgatgataacagaagccgttaccggcttcagctggggcatgatgatccggaaaaatgtctggaacggcccgcagccgtcaattgccgccgcttcctcaagggcaacaggaatgctggtaataaagctggaaaacaaaaagatgctggtgggaagctggaaggtgatcagggtcacgatcatgccccagtaggaattgattccctgaatctttgccataaaggaatacagaggaaccaaaatgcttaaggggggatcatcatgacacccataataaaccctttcaccagattattaagcctgctcttatttcttgcaaggggataagccgccatagctcccacaaccacaatgaacagaattgccatgccgctgatgatcaccgtatttttaagggccaggagcatccctccccgttccagtgcggtgtaaatgttttttaagtaaaagtatcccggaaaggcccacctggaggaatggtcataaggggatttaaacgcaatggcgaccaccatataaatgggcacaaagtggactgcaatgatgatgagagccagaatatacttccaggcattggaaactcttgatcctttcattacgcatccacctccttcctgtcaaaataccccataaccacattgctgatgatcataatcagcaggaatgaaaaaatcccgattgcagaagcatatcctgcggactgagcggagaaatactggttggtaaccaaagtggacagggaatgagtgctgaatcccggtccgccgcttgtaagcgccataaccaggtcaaagagctttaatcctccgatcaggtttaaaatggtagaggaagaaatggccggcatcagcaggggaacggtaatgtgcttaaaacgttcccagaaggtagctccgtcgatcatggctgcctcataatacatgttgggaacattctgaaggcctgccaggtaaatgaccatggcaacgcccacaaactgcagggaattcactagaacgatgatccagatggctgttcctgaatggaccagtaaatccaccggctccatgtggagggcggtcagaatatcattgaccgcacctccgtcatactgaaagaagaaatacatgatgtaacccataatcagcggagcaatcataaccggcatatagataatcgttctgacaagggaacgtcccttaaactttgtatttaaaaataacgcgtagccaagacccagtatattctggatcagggtactcataacaccgtaaataagtgtattgaccagtgctgtctttacatttgcatcctgaaataatctggcataatttttaaatccaacatatttcatagtctgggaatatccattccagttggtaaaggaaagccggataccctggacaaaaggataaattacaaaaaccagaaacagtatcactgccggaatataaaacagattgatcgctgattttttttgaatcttcatgtttactcctgtgctttcttttcctcatagcttgtcttcatctgatccactgcaacggtaagggaatctgactgtccggaaacaatggtagctcctgttacacagaggtcattccacatgccgcttggaaggtattttctgtcaaaatacggaatgtttaaaatggaactgtcatttgcatacttatcatagaaaggagccagtctgcccgtatcgcttaccacgttgtcaagtccggaaggcataccgcatttggttgcaaggtaagaacaaatgtcttcacgggcaaggaaatccataaactgctttacttcttccggatgctttgtggtctttgacatgcccactgcaaaatgctctcctgtcatcagagaccgtttcagccctgcttctcttgcaggaagaggcataaagcccattttcgtatccgggttctgaacataagtctctgtgattccgctggctgcagtaaacataaatgctgacttgtcagctgcaagggccttgataccggtcatgaaatctgctgtaacggcatctgtattaaagtatcccttctgcctccaggagtcgatctggtttacgaccacattccatttgctccagtcaaagctgccgtctaacagagcggactgattagcctcatcctcgtttgtgatcaaagtaggcgccacgaaatccatcatattacccatggtgtagctgtcttttcctccaagctggatcggggtaagtcctgctgccttgatcttctcgcaggcttcctcaaaatcagcccaggttttgatgtcatccacattcacgccggcttcttccagaacattttcattgtagatcattccggttaaatccatgtcaatgggaagggtataaaggtttccttcaccgtccgtgatctgttccttgatgcttggggcaatgtgagatgcaaattcaaaatcatttaaaggagataagtattccgcatatcttgcaactgcccagccatgggttgtccacacatcaggaagctggttggaagccattctggtcttcatgatatcggaaaaattactgccaggcatgaccgcttccacgccgattccggtttcctctgtaaactgcttgcaaacatcctgaatggcatcgctgacagactcaccgtttaagttatataaaaattcaatggtaacacctgtggaagctgctgcttccccttttgattctgtctcttttactgcttccgcagctgtggtcgtggttgtctccacaggctcttcaggcgccttggagcagcctgacatgctgactgcaatgaaacctgccatcgcagcaagtgctaatttcttcataaatattctcccttacattcctaatagtttttagccggctattttgtaaccttagtttatcatagtcctctggaatccgtaagatactcaaatctacactttcaggctcatttccatcattttccccatgggggattgaaaaacattgataatatggatacaatataggcccaggaggtgactcaacatgaaaaaacgccaaagctttcaaaaccggtttttggccctgtttctcatcagtattgttatgcccatcatcatcatggccaccatacttgccttttactttcaaaacaggatatacagggacaatgaaaaatacttttcaacctccctttactccatttcaaccaatttaagcacctatgtatccgacttaaaaaggctggctcttaccccttatatttatgatgatattctgaacttttttgcagctgttgaaaatgggaaatacacaaaggatggttcctcagactaccggatcgagcgccaccggcaaaattataccacttccatgcagcggattttaaataccgccagggaggatattctggcagtatctttcatgcctgtaaacccggacaaccatatcatcgtcactgcaacaaaaaccagtgatcttatgaataccacagactatccttaccagctggaaccctggtatcagcaggttttacattcaacggacccttattattttatggtttcagagcctcccccttatatccgcgctgagacaacggtcatctccgcccttcatacggtccgcaacgtgtacaccaaacggaagctgggcgtcatacggatcgacgcctccgacaacatcattaaggatattttcagcagcgtaagcttaagcgaaaattcaggctttgtgattgcaggccaggacggaactcccgtctaccaggttggaaaggtggagaaaggcgtccttgaaacgctttcttcccctgataataaaatccccactggctccgatacctaccgcctgtataaaagtgatatttcaggaatgccctggcagcttatttttgtctcctcacaaaaggatatatttaagcaagtatccattgtgtggagccttgctgctattttaagcctttcctccattctggccgcattctccattttccgctccaactcaaaaaagactgcccttgctttaaattccattttaaatacaatgaaaaaggtggcacggggtgacttggaggcttctgtccctgacacagaccttttgcagaacgattcctttaacacggaagaattgtccctgattgcggagaatctaaatgagatgatccgtaagctggagctttatattgaccggtcctataaatatgagattgaccggcaggaggcagaataccgggcccttcaaagccagatcaacccccattttctctacaataccttaaactgctttctcaccatgaaccggatcgggatgaaaaaagagctggaggacagcattatccagctcaccagaatattccgctatacctgcagcaacgcaaagctgaccacggttgaagaagaatttaaattctgcatccaatactgcaatctccttaaaatacgctatgatgaacggctgacctttataagctccatggaggaagaagcaaagaacatctccattccaaggcttctcatacagccgcttgtggagaatgccttaaagcatggaatggacggggacggtatttccattacgatctcaatctccgcctccattgagaaccataccctgatcctggaagaaaaaaacaacggaattcccattcatattaaggaagtatactccgatggaaaggttggtataagaaatgtggaaaaccgggtaaaaatctttcacccccatgcctcctttgaaataaatctgactggagacattacttccatgacaattaaaatacctctggaaggaggaacctctttatgaaaattcttttagctgacgatgaacgcctgatccggctgggattaaaaagcatgattgaggagctttatcccaacgttcaccggttttttgaagtagaaaacggagaaaagcttttagaacaactggaaaaggatacgcctgacctgatattcctggatatccacatgccaatgctcaccggtctgcaggctttttcccggtttcatgagcagcagatcccggtggtcatgctgaccggatatgcggagttttcctatgcacaggaagctttaaggctgggagccttagactatctattaaaaccggccagtcttgacgaggtccgggctaccatggaaaaagcagcttctctttttggagagcgggagcttttgctgaaaaaagattatgaactggaatttgaaaaaattctcgacctctatacatccatccggtttttacagactccaaggtacgttcttcccccttacacggctgttctgttttatgttgaccattaccataaggaaacctttaaaaatgacttggatgagttaaataccatgctctcttctatctcctcccgccacggtgccaggtttacattgacatttcttcctacaggggaaatctgttatcttaccagcacggcaattccccctgaggagtttaagaaagaactcagccggtttcaccagaccagcggatgcgttgcaaccggatttcacgtttcagccggagatctttctcagctgtttgcacagtttgaggccgttcaaaaggcagacagcctgcgattttgcgttggccttgggtcggttttatcagagaaagaacgattggcgttttcccctctcctgcctttttcggatttgatggaaaagcttttgattgcccgccagacagatgatgtgattggtttccagaatctgctccacacactttccctttttcctcatgaaaaagaggtctttgaactttgtgatgattccttaaaccgcattcttaccatggaatccggtacagcggccggtatttgctccatcagccggctcgtagaattttttaagcagatgacttaccaaaatcagagcattgacttaattgataaaatcaacgtttatatggaagagcattatatggaccagatcgggatcaataccattgcggatatgattgatatttcacccaactacttaagtaaaatctataagatgaaaaccggagaaaaatttgttgaccacttgaccggggtccgtataaaaaaggcaatggagctcatgtcaggggacatactgccacggtacgggatactgcagagcgggtgggatatttcagcacaaggtattttaccaaggttttcttaaaaagtacgggaatctcaccttccgaatatttaaagggccatatgctgagcgaagggaagcccactgctccataatagcccggaactgtttttcatacagccaccatatggatgctgatacaaatatttcaaaaaatgattaaattactcatattgaccgattcggttcatggtgctataatcaatccataaaccgattcggtcaatactatttcagaaggtgggaacatggaaaaatttaaggaactctcagaagaaaagcagcagcccatcattgaggcggcattaaagtgttttggaaggcatgggtataaaaaggcctccatgggtgacattgcccaaaacagcggtgtgtccaaaccaatgctgttccattatttcggcacaaaaagggatttatacttatacctgtcggaatatgtgagaactgttatgattgacgcatataagcgcagtgaaatcaatgcatatgacgatctgtttgaacgcattattgcggcttccagaatgaaaatgggcatactggaaaagtaccctaatatattgaaatttattatcagcatgtttgaagagaccgacgatgcagttacggatattacaaaaaagatcatgcccgaatcccagcgtttttcctatgacctggtgttaaagaaggaggatgcggttaaattcaaggaaggcgtgaatattgatgaagttatgcgcctgatgtttctcatggccgaaggatacgcccacgaaatgtccgatgagcgttgcggccttggggaaataacagaagaaatggaaagaatcatgaacatgctgaaaagcaatctgtataaggaggaatacctgtgatgtatatactgaaaatccatgataaagaagctgcttcccttaaggtgtcaggaggaaagggcgccagtcttgcaaggctgatcaaacggttcccggaaagcgtgccgggaggctttattattacaacagaattttttaaagcatatatccttcccgccgtaaaccttgcctgggacgatgcaaaatccgccgttgccggtctgaccctgcccgccgaagccagggaactgatccgatccgcctatgacggcctgggtgataacatttccgttgcagtccgttcctctgccacagccgaggatctgccggatgcttcctttgccggccagcaggacacttatttaaatgtctccggttttgaagccgtaataaaggcggcagtcaactgcttcgcatccttgtataatcagcgggcggtttcttaccgggccaaaaacgggtttgaagaaaaggaagtccaaatggcagtggtcgtacaaaaaatggtggatgcaaaggcggctggggtcatgtttaccgccgatcccataacctcagaccgttttacaactgccattgaagcagtggaaggccttggagaagatctggtgtccggacgcaagatcccggttacatggacggtcaaaggcggaattgtaaaaaaaagaagcggcccggagccatgtctgaccgaaacccaggtaaccgccctttctgccatgggaaaaaagattgaaagggaattcggcagtccccaggacatagaatggtgctttgacgggaagcggttctacatcgttcagtcccgggcaatcaccacccttttcccctgcccctcctcccccgacggctttaaacgctgttttatctctgtcggccacttacagatgatgaccgacaccatgctgccccttggcatgtccttttggaaattgatgtcaaaaaccgtgaagatcacggaaatcggcgggcggccatatatggagatcactcataacttaaacagtcccgtaggcaaagctctggtacggcaaaagctgtccaattccgacgaactgatgaacaacgcatacaatcaggtcctgggaagaaaggattatttgaaatccattccaaaaggccagaaaagcgattttgccattccaagggatgtgggcaaatgcatcactgccggattcaggatctaccggaaaaatgatccggccatcattgacggctacaaccgccgcatggaagcaacagtccaaaagacaaaaaaaggacttgaccgtctgaccggcaaagctgtaatcgattatattgttaacgacacggacaatctgatgaaaagcctgtttgacccggaaggcttagggccgcttatggtcgccttctacctcacaaagtccattgataaagcaggaaagctcctccttggacgggacaatataagcgttgatgtgtcaaaatccataaaggggaacatcacctcagaaatgggattttacgtcagccgcattgcagacgctgcaagagattgcccggaagctgtaaaataccttgaaacagcaggggattccttttccacttacgaattgagaaaacagcagggcggagaggaagctgcaaaagcctttgaagaatttttcttacggtacggaatgcgctgccccggggaaattgacatcgcaaagccccggtttgcagaggcgcctgaaaagatccttcccaccgtgcttgccgacataaggctccctgaaggccatgcggagcaaaagctccttcaggggaagaaagaaagcgatgaagcggtaaaggccatggttctggctgcaaaaaagaaatggggagccaggaaggccaggaagctggcaaagcagctgtccttttaccggaattttttaggcctgcgggaatccccgaaatattactggatgaagcggtattgggaatacaagcaggcgatcatccgggaatctgaaaagcttgtgaaggaaggcaggctgagaaaggtagaagatgtattctatttaagccttccggagctggccgccttatttgccgagaaccaggaacctgattatgggaaaatcgatggactgcgggcggattatgataagtacgcctctttaacacctccccgcctcatcttctctgacggagaagtggtggaaggggaatacaaacgaaaggttccaggtggggcgctgccagggcttgccgtatcaggcggcgtggcagaaggccgggccagagtcatcctggacataaaggaagcaggcagaatagaaaagggcgacatcctggttaccaaatttaccgacccaagctggacaccggcctttatctctgtgagcggacttgtcacggaggttggcggaatggccacccacggcgcggtcatcacacgggaatacggcctgcctgcagtggttggcgtgaccgatgccacaaaacacattaaggatggggaccggatccgtgtaaacggcaatatggggtatattgagtttttggaatgagaaaggagactcaccggtgaacgcaattcatattaaaaacctgaccaaaagctatggggatcacagaggtattgaggatgtgagcttttccgtagaagaaggagagatcttcggctttatcgggccaaatggagccggtaaatccaccactatccgcacccttctggcactgatccatcccacctccggaagtgcggaaatctttggcagagactgcatcaagcaggccgctgaaatcgcaaaggatgtgggatatctgcccggagagtcctcctattatgacaatatgacggtccgggagctggtaacgtacgcggcagatttgtacggcgtaaagaacgatggcaaaataaaagagctttccaggcgcctgggcctggacttgtcccgtaaaatttccgacttgtccctgggcaacaaaaagaaagcagggatcctgtgcgccctgctccactctcccaggctcattatattagatgaacccaccagcggcttggacccgctgatccagcaggaattttttacgattttaaaagaagaaaacaaacgtggggcgacgatcttcttttcttcccacgtcctgtcagaggttcagaaagtctgcgaccgggtggcaattttaaaagaaggcaagatcatcagcgtacagaaaatcagcgagcttcgggccaacagccataaaaaaatcagtgttacggcagaggaaataccggcaggctattttaaccttgtgggagttaccaattatcatcaggagggccatactgcctcattcatgtttatgggggatatgggagagatcctgacaaagctgtctgccttaaaggtccacgacctgtttatcgaagaaccggcgctggaagaaatattcatgcactattacaggtgaggtgaaggggatgaccgtatttaagtatgaactgaaacagttaaagaaaaatatcattatctggtccctgtccatgggcgggctgatctttctcatgctgcccacgtaccttggctttatctcagggacaaatgctgtgatggtggaggccataaagaccaatccgatgtttgaagccttaggactcagcgccgcctttgtcatgaccccccttggcatgttcagctttttaaacagctttgccatgacagcggcggcaatccacggaatgagcattgccttttcctcccacacaaaggaatatatgaacaaatcagcagaatttctgctgacaaagcccctttccaggcgcagggttttctttagcaagcttcttgcctgtacagcagacagcctgattgtgggagccgcctatatcacaggagcagcactcgcccttatgaccgtcaaaggcatttccgttgattggagggcattttttctcataggaaaatcccttgtgctgctggagctgatgtttgtggttttcggaacagctgcagggacgtttttccccaatgtaaggacgcctgttctcatatcctcctgcgtcatgtttgccctcttttgcttaagttccatgtcaaagaagatccaggaaccggtactgggctatttcaccccctttggcttctttgatcctgtcagaatcgctgaaaccggattttaccaatggaattatgtggtgtggtatgtgatcctgggcggggggctgttgtttgtcagctgcagagtatttctaaaaaaagacgttgtatttggaggctgagcatgaagacgatatatttaaaagagctgaaattgacgagaaagctgttgatcatatggctggtgctgattgtaatgcttacaggatttgcagcaatcgaatttgtggtgctgaaggatgcaatgggagaaatcgcggaactggcagatagcttcccaaaaatcatattgattttattcgggctgaacggagtgagaatcgacactcccctgggggcctatcagtgcatggtattctggattgacttactggccttcttttatgcgggattttcaggggtatatgccgtttccagggaagaaaagtttggcacaagcgagttcctgttctcaaagccttataaacgttccgccatcatttgggcgaaaatcggggcggcagtaacaaatcttgggatattttccctcacggtggggatcatgtcatatttgtgtatcatacttccctgggtgacaggagcatcgcgggcacgcatttgatcacaacaatgggaatatttatcacccaaactgtgcttttttccatagggcttttcatttcgggccttgggaaaaattataaagccgcaagtctcattacaatgctaacggtcctgaccttttacgtaatcagctttgcgctggattatgccggcaccgtggattttttacacgctctgacaccggtgagctattttgatgtggtgtcggtttcagaacacggactaagccctttctatatcctgctttcatttgtgatcattttggttagctgttccatggctggccggctctacacaaaaaaagatttgctcccttcgtaaatagcaaaatagcggaactgggtttatcaataacccagctcctcatcaacagaaagccaaaatgagtgatccgggattcctttaattatatctttttcgtccgctggcatccggaatcccggcttcctcacggtattttgcaaccgtacgccgtgaaatagagatgccggattctaaaatcttctcaccgagaatccggtcactgtacggctttttcttgtcttcctccttgataatatcctgaagaacccgcttgatatccccattcgtcagggtctgtgctgcttcatgaagccggctttcctcatgttttattacacttctgggaaaaaagaagctcatgggataaactccccaggaacactgaagatacttcttactgacagcacggctgacggttgattcatgaactcctatggcttccgccacatccccattctcaaagggattaagtgatttggcccgttcataaaaaaagcttcctggtattccaggattttttttgatacctgcatgattgtctttgagcgctgtgcaacacaatgcctgatccattccgcctgccggattttattatccagatatgcttttacttcctccgattctctgcgctggttcatctgctgataataacagttgatctcaattcctgaacaggaagattcattcagcagaatatcaaaatgatctctaaacttcacaattgttacatcaggaacaatatagcgcatctgttcgcggttaccaaacgaggtgcctggttttggattcagtgatctgatgatctgacaacatgctgctgcctctgaagaagacaaccgcaattttctttttatggcaggaatcttattttttgcaaccatctccagacagtcatcaatgatctgagaaagaaccggagacagcatcttccggcttttcagctgcaattttaagcattcctcaaggctgcgggcacagatccccgcaggttccagcgtctgcagtttttccaaaagtttttgaaccaggaattcattcactttgaaataaaccgaaatatcatgaaccgattctgtcaggtatcccttcccatccaggcattccagcatgaatttgacgattttcgtctcaagtgaagaaaagtcctccataatcaattgtgaccataaataattctgcagcgtttctccatcatcggcgttataattccagctattcttataatcatcatcatcgttctgctttcgataaaggtaataattttgttcattaaaggaatccagccaccgctgctgttggaagggtgatacaacatctatggttggattttccaaagccagctcattgatatatatatccagctcctcagctgtcatctgcaggatttttgcagactgtatcatctggggcgataaggtttgcccctgtttcatctgcaaatctaagttcatgttttcctttcctcctttccctgacatcaaaacaacattaacgaaaaatctgctgctccactgaaaaagaaaatgcaaagaagaaggcacccacggcaccctcttctttctctttcttaaagatctaagccttgcgcatatagcttatacgtttccagctgtgataaatccacgtcatcaagagtgatcggctctcccttttttacgtccttaagcaaagccatgccgttcagcaaatagaagggagccaggttctcaacggattttctttcaagaagttcaggaatcaggccatcgatcgcatgatgatgtccctggactgtaagcacagttcccttgggtaaatctttttcagccacacctgccagaacagatacctgacggcattcgggatgagtaccgattcccataaaatcacctaacaaaacagagactggggtttcaagtcccatataatgataaggataataaatacatgcatacttgccattgctgctcattacatgtcccttgcccttcagaatatcccacatcttttcattttcacatttaatgataataaactctcctccgcagaagcttgcctcgtccgtacctcttaaattatagaatacatctacaactcccgtctttttcaggatacctccatcttcttccggaataaaaatattggcaagttcgctggtcttagcgatgggatagcttaaaaatggggcagaaggcaccagtccggtgatgtttgaaacaaggttcatctcgcagagatccgctgaaataaccccggtatacttttccagcattttgcgccgttgattcagggtttccacgcccttataactccaatgctcaaacatctccggcaaattctcactggcactgtctccatctaagtaagtgaattctcctgtctcccgatcccagacaaaatcgtattcactggattttccggcagctaccacttccagtcctaaaagcatggcccaggaataaaggtctaaaagattacgtggctggtcaccgttaacaagagcataaacagcaccgttttcaacagccgtctggtttaaaaccgggccgcacacactgtcggtctccttggaaaccatataaacattaattcccttcccaagtgctaaaagagctgcatcagaacttaccgcagtatttccggtgcattctacaagagctgtaatcccgctttccataacaaggcggtaatccctgacaatgagaatggcatcttccggtgcgctctcaatctgggctttctcttggcagaaaacaatcctgtcttcctcatacccgatttccttcagcacttccaggcactcatccggatgcctggaacagatgactctcaaatccatgagcctgacctttgggatctgggcaagcagcgtatagccataaccacgggtagctcctatgatacctacttttgatttctttccggtattgtcattcattaaatttgtataatccatgttgtgcattactcctttactggtattaattagtgatctgcatcagctttgcagaagtggctggaaacggagagaatcaaggacggaacacaatcttgatcgcagcgtcatccttatcagctaaatcaaacccttccttaatgtcagccagtttaaattcgttggtaatcaacggtttaatctttacggtaccctgaatgatggggcggagtgtttctggaacccagacataacgctgctgccatgtatggtgaaccaggcaggtattaacaaattccagaccatcatcatgccagcggctgatgttcaaggttaccggagtggtcacccagctgtaaaatacgaatttcccgttatggcggatcagcgcgcttgcagcgttaaaggattctgccgtgcccgccgcttctaccaccacgtcagccccccgtcctcctgtcagcgcctttactcttgcaaccggatcctcttctttggaattgattacaatatccgcgcccaaggtttttgccagctccagctttccatccagaacatcgactacgattacctgataagcccctttcagcttggagcactgagcaatgatctgtcctgcatagccgccgcccatgaccacgacaatatcaccaagctgtacgccggtatttaagccggaatacattgcacatgcagtgggctcaccaagtgatgcaatgtccatatccaacccttccggaaccggctggagctgaaaggactttgacttaaaatagtcagcaaaattattgttccagccgaatgcgatgaccttatcacccaccttataatcgctgacacggcttcctacagcaactaccgtgcctccgctctcatgtcccagaagaaatggaaactccggcggctggcggaattccgctgtctggggaggcataaatccccggtaaaagctcttatcagaaccgcagattcccatcatatggtttttgacgataatatcatcctcttcacatactaattcacgttcaatcaactcgatgtcataagccttgtttaagcgtgctgctcttgtaataaatttttccattgattcctttcctttctgtatgtaattcccgtcttgtttcagcagattgattttaaagatcagataacatgcaaggcaaccaggatccaggtcaatactgctcctataaatccggctatggtagaggcccccctacggcgcggatcccctgatttacatccatatttgacatagaaaccgttacccagaatccggaggaatttgcatgcttaaacatcagagcgccggtaccgcaggccagaaaagcagctatgggagagatgcccagagttgccagcatcggctcaaccaatgcggctgcagtcattacacccaaagcattggaaccagtaaccgcatggataatggctgcaatgatgatgggaattaaaatcgccgggaatggagattgtaccacagcacctgcgattttttctgcaacgcctgcattctttacaaaggtagccagagcaccgcccataccggttacaatgatcggcattgcagcggcagtaattccttcatttacccagtcatttagtacctttttactcttccattccttgcctgccaacagcagggaaaggaggcagccggtaaataatgccgccaaagggcttccgataaatgcgaagaagtttgcaacaggagtatccggaacaactacggatgcaccggtattgaccaggatcagaaacaaggggaacaaaatcggcagcaaagacttggaaagggtcggcagctccatatgatcgctttcctttgccgctgtcaaaaactcctcctttggggcaacaggggtctttaatgtcatacaatacaaagtggcgccaattacacttggaacggcaacgatagctccccacaggattgcctgccctaagggtacgtgcagcaaagctgccgctgataccggaccgggagtcggaggtactaaagatgcggttaccaaagctccagcgtaaagagccgtgccgtagctcatcatggatttcttcgtttgaacagccaaaagagatacgattggaatcagcagaatcactacagtatctgcccagataggaataccaagaatcgcggagctgagagcgatcgcccagattatatttttttcaccgacaaggccaatggcccatttggtgatccggatcgctgcaccggtcttctccagtaccgtgcccagagtacagcctaagaagattacgattgccacgctcttgattgttccggcgaaaccgctgtttatggtatcttcaatttccttccatggggttcccagtgcaattgccaggattaaggcagagatcaggataccaaatgctgcatttaccttgcacttggaaatcaggatgatcatcagtacaatgaccattgcaaaaacgataagtacataggatgttgacataagattaaccctccattattattttactgctgtccaatttcacctgatcagggtagagacgggcgatctggttcacagatcagggaaaattagaaaacaagcgtttgatactctattaaaaagcaatatttatgccaactttttaataaactttaaaattggagtaaaaggattataaacattgtataaaacaaaacgtatcaagaaattgaaaatatacaaaatagaggtgttatcgttgcaaaacaaaaagcgatgcaacaaatgcagcgcattgcatcgcttttgcatcatgagatgattagatctgatatttctgcagtttacgccacagggtagtacggtccatgccaagcatcttggctgcccgtgttctgttgccgccacattgcttcagggcaaggcgcagcttttcaggctcactgagcgagtcgccctccggaagaaggcagacggaatccggaggggaaacagaagctgcttccagatcctgaggatagagagcctcctgcagattctttttactgataaaacttcctgtctttaagacactggcacgctccgctatatttttcagttcccggatatttccggtgaacggataccggcgaaggaggggcagggcatcgggatccagttttgggagcggagtccgggtttcctggctatgaacctccaggagatgaaggaacagcagctctgcatcattttcccggctgcggagaggaggaaggaacagccgcagcacatccagacggtacattaaatctcttcggaactcaccctgctgggaaagctggagtatgcttttatttgttgcggaaatgatgcgcacattgacagcaataaccttgttatcgccaacccgcctcacctgcctctcctggaggaccctcagcagcttgctctgggtggacagagagatttcaccgatttcatcaagaaacagggtgcctccgtgagcctgttcaaaaagccccattttaccgcctttgctggttccggtaaaagcaccttccacatagccgaacaactcactttccagaagattttccgggagtgccgcacaattaatggctacaaacggaccgtttttccgattgctgctgttgtgtatactctgggcaaacagctctttgcccgtaccggtctcgcctacaataattacattggaatcggacgcagcataacgtctggctgtctcaatggtattgtcaatgatactgctttgatggatgatatcctgaaaggtatatttggcctggagcccacgttcgctcagcttccgacggatctggctttctagatcctggatcatggtaatgtcagtaagattaataatgactcctgaaatctctttattggcaattaccggagtgcagcttacagaaaccgtagttttggttccgggaatcgtaaggattcttcctgtctcctgctggccgctggcaatcacagaacggaaaattttataaagatatggaagcgcctgctttaaaggacggttcatcaggctgacgtctccgttcatccggcggatggcatggttgcggacctgaatccgccctgctgtatctacataaagtaaaccatccttggaggaatagataattgttttatacatctgggaagtaatccgttcatggcggatccggtctaccgtattgattgcttcatcgattgcctgaagaagcgtatcttcccctgtcctgattatgacggaaggcagtccgtactgacgggccagaatattagcggaatatccgccaatcaaggcatcacatccagcagcaagtgccttttccaacgttttcggcaaatcttcgtgatggacaggagcatagatctctgcgctgatatggaaaaactgacagatattctttgcttcatacatctgtccgctaaatccgcagacagcaatctttttgggatgataggcctcgcagcattcagaaattgcccttaccatatcatatcctgagattgacagccctatggttggaatctgtgtatacatggatgacgttttccgggcagtatatcctctggcaattatagcatcatactcatctgtggggacatccggtgtttcttcaaccgtcatgacctggatattcgcattgagacgatttttttccgtatgatgagaaaggacatgttcaactttttcttttaattcaggatatggaacgataaataaaagacgaatcataagatacctcctggtatgggtaagaaaagcaattagtgatgcaggatgtgttgcattgctacaattgtacaacattgcaacattggtggtcaatacttcatagagcccttaattcacatttctttccgtgtaaaaggcaagcaatatgatatgtctgtgggatttgtcaagaagatggaaacctttgaatattaaacataattattatgataaattggcatgaaaattgctgtataatatatttaaacggaggaaattcaaagaaagggaggatgactatggctgtatttggatgcattgccgatgattttaccggcgccagtgatgcggcttcgtttctggtaaagggaggaatgagcgttcagctttataatgggattccggataaccatgtgacgaaaataaatgccggcgaatcgtctgtcattcatttggcaaaagctcaggcaatcgtcatcgcattaaaatccaggactcaggaaacagaccaggcagtggcagacagccttaaggccgcccgttttctgctatctcagggcgtggaacaaatttattttaaatactgttccacctttgattccacaccaaaaggcaatatcgggccggtagcagatgcattaatagaccttttgaaagctccttatacactgctgtgtcccgctcttccggttaacgggagaacggtggaacatgggaaccttatggtaaatggggtttttcttcatgaaagccacatgaaaaaccaccctcttactcccatgtgggacagcaggatccaaaaactgatggagccccagagccggtattcatgccgtaatatgacattggaagaatggaacggcctttcactggacactctgcttaagaaaccgttttatctcattcctgactataaaaatacagaggatggggaaaaaatcgcatctgtatttggacagctttctctcttaacagggggaagcggacttttggagcccctggcaagaatctggacaaggaagctttccgcaaaaggaaaaatcccggaaagcggtactaggggtaaggcacttctgttagcaggaagctgttccaaagcaactctggaacaaattgcatggtatcagggccagggaaaaccctgttataagcttgatccaaaagcaatgatggagggccggcagacagcagaggaggcctggaaatttattgaggcacacagcagcgaatcagatgctgttctggtgtacagttctgatacgccggaaaaggtaaaagaattccagaagcttggaaaagaaaaagtagcggatatgctggaaggtacaaccgctgcattggctgttcatgcattaaattccgggtataccagaatcatatccgccggaggagagacctcgggtgctgttacaaaggaacttggattttcttcctactggatcggagaaagtgtcgctcccggagtaccggttatggttcctgcagaaaagcccaatgttcgtctgattcttaaaagcggaaactttgggcaggaagatttttttggacgggctttgactatgacattaaaataaaatcagaaagcgaaacgtggattcgcttcagacttggaggaaaagatggactctgttttagaagaaaaattaaaagcagcagtatggacggctcacagcttgtttgaccggggaaaagccaccggttcttccgcaaatatgagctttcgccataatgatcagatttatatcagtgccggcggctcttgttttggaaccatgagggaagaggactttacagcaattggcccggacggaacgttcggatcctccaaaaaacccagtaaggaatggccgcttcatttggcactttatgaaaagtcaacggaaataggagcagttatccatacccatagtacttactctgtactttggagctttgtcccttcctcttcagagcatgactgcatcccggaccatactccgtacctgaagatgaaacttggttctgtaggcctgattccttatgaaaaaccaggctctgaggcacttttttctgtatttcgggaacgggtaaataaaagtgacggcttcctgctaaaaaatcatggcccagtggtgccgggcaagacaataatggaggctttctactgtctggaagaactggaggaaactgcacgtatagcctgggaattataccgggcaggactgaaataaaggcactttaacagtttcctttattaaaacataaaaaatcacaacggcctttcaaaaaccgttgtgatttttaatatcccaattcctcatttacgataattaccttgatccgatccttcacaaattgtcctgcaattaaaacaaaatcattgcagatcctctccttgtgtctgcagtcaatgcagcggtcaagagccgtacagggagttgccttattaagccgctttgcatccaggggagcagcaatctgcctggctctcttcactgccgcctgagcatcttctgttatcttattcgttcccacaacaacaagtacctgctttggtccatacagcatgggggcgacccggctcccattgccgtcaatgttaaaaatctttccgtccatggtgacggcattggccccggtaacaaatgtatctgcagaaaaattttttaagtatatctcacgtttttcttcccgggtaagggccggatcaaatttgtccagaaagttgatcttacgttttctcagatcatcaaatactcccgtctgctcaagggtaaccgaatccccgcagcctacggtggttccatctgctataaacgtcctcaaaagactcagaagctcctttttatccctgacatggaaacctgtcatgttattctgatgaaggctttttatcaatgacggaatgtccacccctttttggggcaaagaaagactcataaatttttcctccaaagttaaatataaggatccctgataaaataatggtcccgccggtcagagtagccttgtccgggacctcatttgccataagaaaaccaaaaatgcttgttaaaaagggagttacaaacatataattgctgacctgtgacgtttgctttgcctttgcaaatgcttttgaccaggatacataggcgatagcgctggagcctatgcccagggtcacaacataaaatatctgaattccgggagcatacagcacctcattgacagatgacggaagaaatacggcgagaaacagggtgccaaagaaaatactgaaggcgctggactggagggcctgataagttttcgtcagttttctctgcaaaaggttgtaaatgctgaccagcaaagccgccagaaacagccagaacaggcctgggttaatagaaaatatcccattcatcaacgtcaggaccaataccccggcaaactggatcccaatggccgcccactggaagccccgcagcctttccccgtaaatggaacgggcaagaagcgcggttatgagcggaaccgtggcaagcacaacgctgccggtggaagccgttaccattccctgccctttgttaaaagcaatcatgtaaaggaaaaaaccggttgccccggaagccatgaaccacaaaacatccctcttccccggcagcttcatctttgtaaagacagccactgccagcagtgccagggaggccaccccataccggagaaatcccagggaaaacggggaaaaatatccaagcgccagctttgtaaacacataggccagtgaccagaaaactatggttgtggccgcataagggtgaaagctatctttccatttcatatttgtacctgcctttaaactgtttattacggttgtcttcctgcctccctatcatttaccacggaaatgctgtaaagaaaagaaacaatcctttccgctgctctttcatgcccagagtcttacaacaacagagaaaacggaaacaccagaaccagcgccggaagaatgttaagcaccctggtcttcttaatattggatatcttcagccccacggcaagggtgatgatcccgccgcaggccttgaaattcgccagcataatatctgtcaccaggggcaggataaaggaggccccgtaaaacagcaaggtccctattataagctggggaaccgcaataaatcccaccagatacccggctgttgtgccgaagatcattgccgtaaagaaatccatgacagactttgcataaagaatggagtgatcccctgtcataccggaattcatggctccaaatattcccgtcccgctgaaacaaaacagaataatcaggctgatgagaacgtcaagctgatcctcgtttaattggaccggaagtctggcctccagcctccgaagtccggtcagcagacggtcttccagactcagaagttcaccgattaccgttccaataatcacggcaaggaccaccgctgtcagactttccagccggatgatcaggtaaatccccatggtgatcgccgacagcccgaatatattgggaagagcttcggccagcttttgcggaaaatgattctttaaaaaggcccccaggatccctccaagaaaaacaacaatgcaattaattatgactccctgcggcatatcttttgtctcctttaacaattcattctgatggtaccatgtttctgtgtattttagaaaacagttccagaaattcttttcttttttcttgtgaaatgccttcaaaagtctcttcttccagcttaaggaagatttcatgtaccctttgctccagtttttgccccttacctgtcataaacacatgaaaggaacgcatgtttccgttcagccgttttctttcaataaggccctttgcttccatcccgttcaaaacgcttgtaatggtcgcggcttcgatgtaacaggctgctgcgatctccttctgggttgctccatcgtggtctcttaaataatccaggaccttgggctggcccgtggtcagttccgtatccttcaggacttccatgagcctcctctgataaatcgcctgatttgccatcagcagatagtgaaatgtcatgattcgtcatcctttgaatagttagatttctaactattatatttctaatcttttttattgtcaattgatttcatcaaatcagattccgaaaacaacaataccaggaaaaacgtgctttcctggtattgccaatataaagtcttatttcatttttctgcccactgactcaaactcctgataaatctctttggaaggcggagatgttaccagtgatacgatgattatagccgcacatgctgtggtaaaggctggaagcagctcatagatattccatatgccgcccaatggacgtactgcatatttccagataaataccataacgcctcctgacaccataccggcaatggcccccataaattgctccgcttccagaacagggcaaaaagcatcaccggcccaaaggaggcaccaaaccccgcccatgcaaaggatactatggtgaacaccgagctgtcaggatcccaggccaggatcatacccaccagtgcgactccaataaccgtaagccttgcaactatcatagaagcttttgtgcttaccttaatctttaaaaagtcctgcataagattctgggatacaccggaagcagcagtcagaagctgggaatctgcggttgacatggtacatgccaggattcccgccagaaccacaccggcaacaatggctaataaaaatccgcttttccctaaaagatctgccagcctgataataacggtttctgcctcagacccggtggacagcatgggaatatggccggcaactgaaacactgtatccgatgattccaatgagaaccgcaacaaacatggagataaccacccatacagtagcaatccggcgggaagtcttaagcttatcttcatcattgatagccataaaccgcagcaggatatggggcatcccaaaataaccaagtccccaggccagagtggagatgatggaaagaaatccgtagggagaggcgctgccatctgacaagtcgtgaacctgaaccatgcttaagtagccctcaagtgaccgggcattctccataacattgttccagccgccagataccagtattccgaaaaagacaatgataaccagtgcaatgctcatgacaatgctttggattaagtctgtggtcgacacggccataaatccgcccattacagtatagcccacaatcacggctgcacctgcaatcatggctccatgataatcaatctgaaacaggctgttaaacagcgtacctattgccttgaatccggatgcggtataaggaatgaaaaagatcagaataataacagcagaaatgcacatcaaaatgtttttttcatcccggtaacgccttgaaaaaaaatccggaatggtaatggaattacacaccatcgaataccggcgaaggcgttttgcgacaagcagccagtttaaataggtacccacagccagaccaatggcggtccatcctgcatctgcgatcccggttaaataagcaactcccggaagtcccataagcagccagctgctcatatcggaagcttccgcactcatggcagtaaccagcggccccagcttccttcctcccaggtagaactcgtcggcagaatcaccgccccctttttgctgtaataaaatcctatgtagaccatactgaccagataaatgatgatggataataaaatccccgcctgccctatgctcataacttccctcctgttgtggaaatgttcagacagctttttacgtaaaccaaaaaagccataatgagggtattatagcatgggtggaaatagaacgcaacgcagaacgaagtatagactatatactagacgttttatataaaatattcaataatctcttattttaaaagggtttaatacaatacggtatcttataataaatcaaagacaggccttgttatcagtcatgattccggtagaaagccgcttaaaaatgaaggcaaaacagaggcactgtactggcgaagagaatattctccgccgcataaacaccagtcatacatgagggacctctcacacagggcataaagcttgaccatttcactgacactgaaacgggtacctatctccccttttcctgtccctgtgcaatgatctttcgaaggagcttataataagtcctgttatggtccaggaggtgtttctctccgttggtaacaagctgggtagatagaagccttgccagcagatcaatggagatactgttttcaatcataccaaacagctcgctgttgagcagcagcagcttttccattgccggcaattccggttcaatgatattggtcagttcttcatatttatcgtcaaacaggacgctcagagtgcttagcagcgcatcctttccgtcaaagtaatgataaaaagatcctttggaagtctgggacagttcaatgatttcttctacagtagtatcctcatatccctgttcataaaataatttccaggccgcatttacgatcttcccctggtattccgaacattcttttttgccatgcccggccctccttgcattcaaacattttgatcttcggttcttcagcaagtataccacaggataggagatgctgtccatttttctatgacagcttaaggctcattttgctgcttccatcttctcccgctttccagcggcagcaataaaggaagcaataaaggacacaatgggaaccgtcatcaccacgcccagactgcctgatatcccctgcatgatctcgattacaatatgattggaattaatgacctgaaggtaaggcagctcataggcatagtttaacagcaaggtgctggctccgctccctacaaatgccaggatcagggtattgaccatggttcccatggcatcccgtcccacattcattcccgatcggaacagctccttccgatccagtttaggattctggatatggatctcaaaaacagtggaggaaatggacatccccacatccatcactgcacccagagccgagatcagcaggccggaaaacaacagctctcccacccggatgccccgtatattttccagcaccatcagggattcaatatttgacacattgtatcccgatatatgagctgcctctccaaataaataggccgatattcctgctatcaccacgccgctgaccgttccaaggacagcacatgccgtcttccctgaccagccgcccagaagatacatggttgcaaaggtggtgactgcggccaccagaactgccgccagaaaaggagaatatcctttgtatatcatgggaatgtaaagccagataatgcagataaaagtaaacagaagcccgacacaggcctgcacccctttttttcctccaatgagacagaccacagcaaaaaatatcagtacaaaccccaccacggcccattctctgtccatgctgtaaaccgtgtgaatggagatctccccggaaatgctctgtatcaccacaacgttcattcccggcttacaagctgccccgaacagatacccattgttgctggtggcctccacccgttcccctttcatgggcccggatttcatttcaatcaggacttcctgctgcccgaccctgcttccatcttcctgtacattgtccttgagaacctccaggacctttgcccgctcaaaggttcttccttctgttgcgatcaggccggcaatgtccacctgattaaaccggatcaaaaaaatggcaaatgcagccatcagtgcggctgccaaaagccactgcgccggtttctgtaatgttctgttttgctccatgctcctgttttaacctccatagggagagacgctgtctttgcaccgcctccccctgtattctgtatgatttcataaaggttatcttttgttatcttctggccgcgctggtctttttcagttcaaatgttttatcgatattttgtggctggccgtttacgatttcataggtatcaatggaaaaggagttgtggttgaccttgatcaccgaataggtgggattccagttctggcttctggccgcaatgtaatcctgctgattagggatcagttcataatacttgctgccggtagaggaattggcttccatgtacaaggtcccatccgcattggttacactgtccggcatggtatttgcaatggtgtaacaattattctcagcctggtaagcggcatcggagtagggaaatacgtttcctgcctcatcctttacattgtcccagtcataaaagtcatagttggaatgggtcctggaatcggatttcagcagataacttctggaataggtatggtcatgtccctgaagcactacatccacgtcataccggtccatcagaggagtcagctgtgtccgaagcacaataccgtctgaatcggagtggtcaaggccgcttccgtaaatatcctgatggaacattacgatcctccaaggggtcttgggataagcagcaactgcctgcttcatcacctgttcatgctcggcgcagttatagttattcgtattcagaatcacatagagggccggaccatatttgtaaaaatagtcgcctccggcaacggtctttcccagctgtgtatcattgggattgttaaagtgaaagctgtagctttcattggtggcatcatggtttccgatggtggtcgcaacaggaagggacttgatccagtctgcatttaaaaatcctgcatactctacctcattgcccggatctctgccttccacgttcttattgatctggtcccctgccgacaggacaaagctgacatccgggttggctgccattgccgtgtttaaagttttgttccagctgaaggcatcattgcgggccgccgtattgatgtccgatttattctcaagggtatctcctctggaagtggtctggcctttggaagctccgatctggggatctccaacgtagagcatggaataactgttaaagccatgggtctggaaggaagcgatctggcttggttctccatttttataataacggtaataataggtggtgttttctgccagagacgtggcagtgaccttattgctcatatatccgtcaaccgcggtcgacgaacttccttcaaaggtgaccggctggctcatatcgctgtgttcagacagttcgatccttggggtaggggttccgtcattttgggaataccatgcaaagttcatctttgtctcatcagaacccggtgtcagtgcgattttttcatagtccttacttacctggtccgcccactgctgcacccagctgtcccatgctccatcggttgtggaatccgcaaaatgttccgtagccgcaaatacatatcctcctgccagagttatggaaagagcagccgaaataacagcagccgcatacttcttcctgactttcatacgtcaatcctccttgtttccgcgtaaagctcctgcgtgatttgttgtttttaaatggtagaagcacttctcgctttttagaataaggctaccttaatcacaaatcaatagactttgcaaaggctttacaaactatatctgaactttacaaaaagaaggccccacgatttgaagcatatgtcaagtctccaaaccgcggggctgttttcccacaactgtctattattctcatcatttgctttcgccggccacccactctttttttatacaccaaagcccggcctgcatatcttcaaattccgggagcccttcacttttgaccacacggtcaaaccgaaacaaattgttccagcttgcagccagttcaccctttaactgaggataaaagggagtttcataaacatccccttcatactttatcccgtatttctcaagcttctcagtatactgattttcctcttcctttgtcctgccaatgtaccttaaattcaacaccttattccagtcggacatccggaaaaatacggcctcctccaccggcaccttaagcttcatcaccgtatatcccggatgccggtccgcatatttttcattaacaaacgtccacacggcagattccgcctgttccggtttttcaacgatcacggccgcctgacggacataccaccggtaggcatttataaaaacgccctttacttctctatatttatcctcaatgtatttcatctttacataatggcaatggccgccttttatagaatctgcaatctcattcagctgaacagtataaagctctatgaatccatctttacaatccattcctttttcacctcccagataattcctaccctggcagggctcagttcgatctctgcatcaaaaagcctgtcccagctttttctgatcttatttttcacgctgggataaaatggagacatgtatgctgtgctgtcatcaatgccgtatctttttaacagcgcgtcatgctccctggcatcctccgggtcttttggaatgtacatataatttacgatatacccccacttgtccaggtccatgataaacagtttctcaggatccaccagtatttccagaagtacatttccttcgctgttttgtatttttgattcttctgtaacagatacccatatgggatatttcgcatcgtttggtatttccatgaatttagaggcagaatgatacagccagttgtaagtatccagatatatcccagcatgctcttccatcttattgacgatgtactctttttttacaaggtatcttccattttgatccagatcatttcgtatattttcatgctgctttgtccacacttttattttctcagtcaaattcattcctccttccgatcaactgatcattaagagtacaggccgttttctttcgcttttaaagctttgaaaccgcctttaaataagaatccatatgagcctgaaatgcagataaggtcttttcaagagatccggttcggcatgcctcaataatcgctttatgctcggcaaatttctctttcatggaacccaaggtggaaaggtcctgattcatggctatcagcagttgaaaatactgattttccaggatttcagcccttcggaagctttctgatttttcccagaaaaatttatgaaaagccagatcgctggtatttaatacaaaggtcttttccttatcttcaatgtcgctgtcacgttccggctttatcatgttttcatttaaagcctccagataatccagatcccgctcctccagcagagatttttcaaaaataatggtaagggtttgcatttcaaggggaatccggatggagaaaacctccattatatcctcataacccatttcaaggatctgactgccctttttgggagaaaaagtcaggatccccgcatatttagttctcttagagcctctcttataggagctctgctgatctgcagctcttccgacatatctgtttccactaaccggtctccacttttcagttctcctgtcaggatcttattttttacataggaaactacaatttcacttagatttgcctttgaatatgtaatcatatggcttaatttatcgtaagaatcaatgaccataatatccacctttcaatataaactctatctaacagaatattatactatagatggaagacaaatcatatgaacaattaaatattctgataacaattctttgcatagttaataaataattcctgggcaggtgttaatatcatgtcttttttctgaacataaaagatatttctgcttaacagttccgattcaatttccaccacattgatcagatccagccgggtataaatctgtgctgctgcctttgaaacaaaggaaatgcccattccctgagaaacagcttccacaattccctgagtattgccaaagtatgcaaccgcttttaattctttttccgaaatgccatgcctggttaagaaggattccatttctgctctggtacctgagccctgttctctcataataaaatttttatccgcgatgaactttatgacttcagacgcctcccggcttccctcatacttcatatccttaggaagtatcaaaaccagctgatccttacacaaaatggtcagagtataacggcaattctcgctttccgtacctacaaatccgatatcatactgatatttaatcagctcttcaaatactccgccgctgtccttctgatacagacgaaagacaatattggggtattccttattaaaatcagcgatcagctgaggtaaaatatactgagcaggaacactggaagccagaatgttgacttctcctgtacattccttggaatacttgcccatttcatacagagattgatcccttaaagccagcatcttctgcgcatactcataaaaatcaatccctgccttagtgggaaataccctctttgtggaacggacaaacaactgggttccaatgtctttttccagcgcattgatctgactgctcagtgccggctgagttaagaataaggattcggaggcttttgaaaaactttgaagcttggaaatctgtacaaatgcttctaactgtttaaattccatatgatctctactttcttatgaacatagccagacagcgcctgccgttttataaaaaacaaaaatgcaggcgccttaagctgtaaggatgaaagaaaatcagctttcagccttgagtttgtgaatcaaaggatatgaaatcatatcctctgattcattagcatacaaacaagaaaaaatttttattcttttttaggagctttgggcttttccttcatcagttccttgatcaggcacacacagcataaaagcatgataatagccagagggaaagctgccacgatggagcatgtctgaagcgctccaaggcctccagtcattaacagtaccagagccagcagagcctggatcactccccagaatatctttttaccgttggcaggctccatgtcaccttcagaggaaaacatggataaaacaaagatccctgagtttgccgatgtgataaaaaatgttcccaaaaggcaaattgctatgatggagaaaatgcttccaagaggatactggcggaagaccacaaacaatgcggtttccgttgtttcgattgcctttgaaataatgcctttatccagatttaagccaaggcttccgaaaacggagaaccagataaaggatactaaggatggagccagtattactccgaaaacaaattcccggatggtccttccctttgaaattctggcgataaatgtacctacaaaggggccccatgcgatccaccatgcccagtagaaaatagtccatgaaccaagccatgatttatctccgaaaggatttatggcaaagctgtcctttacaaagtcattcacataactgccgatggagtttgtgaaaacatttaaagtcagaagcttgggacctacaagaaaggcaccggccagaatagcaattgccagtacaaggttaatgtcagacaggagcttaatgcctttgtcaattccgcttacagctgtccaggtatagatgaccatcagaataatgataataacgatctgaaccaaacgtgttgttggaacatggaacaggaaattcagtccggaattgatctgcatggttccctgtccaagggaagttgcgattccggctaccgtagcaaaaaccgcacaaatatcgatcagctttccaatcggtcctctgactcccttttcacccagtatgggaagaaagatgctgctgatcaggccgggagcatttttcctgaactggaaataccccagtgccataccgatgatcgcataggctgcccagggatgaaatccccagtgcataaaggattttttcattgcaaagtttgctgcttcttctgttgccccaaatgtcatatagtgattcagtggttccgcaacgccccagaaaaccaacccaattcccattcctgccccaaaaagcatggcaaaccatgaccggttgctgaattccggaacggaatcatccggccccagtttaatatttccgtatttgctgaatgcaataatcaaagaaaatgcaacaaatacaaacatggaaatcaagtaaaaccagccaaaattattgacaagaaaatcatttgccgctgttgtggcctttgcaaatggctgtggagctatcagaccaaatgcaacaattgccatggtaataagaaacgatatgtaaaaaacctgattcttcttcatgtaataccctcctctttaaaatataatcgtttgctgtttttttgcaatccgatttttgcatgacaggataaaaatttatcctgtcatgtaaaaattcttctttcagaataacgtttaatcatgtattttacgctgacggcctgcggcgtttaggggaaggtaatgatttacgccggccttcagactctgttataatgaaatttaaattttaactttaaagagataaggttcttttatatccgttgtcaacgcatccagagcaactcccactctgtgataacgaagcttgaactgctcttccttcggtgtggcaggatctccaaggggatatggtatggatatggtgggaacaagtctgttcactccaactgttttagctacaggaatcaggttcgccatctgaacgatggtgatgccttctctttcaatttctcttgtcatcgttgcaccgcaacgtgtacaggtccctcatgtggaggtcagaattgcagctctgattccatcctttttcagttctcttgcgatttcttttcccattctcgcagcttcggcctgggtcgttccagtaccaacggtggagaagaagtatttgtatactccgccgatctttccttctttctgataccgcctcatggcatctaagggaacgattacgtcagagtcgttgttggctgctgccggatcaaacccagcgtgaatggtcatatattcacccttcacaaggtcatcggtttgggaaatgtcatatttcccccacttggttgctgaggctgactgaatgcggtccggatttcctaccggaacgattcctccagaagtaatgagggcaacctccagcttgctcagttcttccggagtgatggccggagcaattgccaccctgtcagactttggaatggcaagctctgtctcatacggctctccatgaactttcttaaggagcatatcaataacacggtcagctgccgttaccggaggatccagccagatctgatccctgactcctcttccaaaataaccttcctctgctgccggaagtaatttctctccctttaacagcttaagggcaaactttgccatagcctttacatcctttttcatggctgcggcgctggctccacccttaaatacatacatgtcttttctgaacatttcaaccccagggttttcatcgttcatagaggtgagaacgggcactccgaactcctttttaaccgcgttgcagatatgaccgcaggctgatccgtaacgtcctgcacggaaagccggtcctgcaaaaaatacatccatctcttttcccttcagcatggaaaggatgatttctacggcttcctctgtgttggaacccataaagttgtcgccgcagataatggtatgtgtgatttcaacatcattgcctaattcctgctgcaatgccagggccggaccaacaaggccttctctgatttccggtttgaaatcagccagttcttctccgccgatctgcccaaaaaactgatttaagtataaaatacctttcatttcgtccctccttttagaattctaccatcctcttggttgaccagcctactacctgatccccgcagaacatggcgttgttttccataataatagaaccgtcttcttttacggaagcccctaaaatctcatcattggaccagcctccggacattccgtcccttgcaagggcctctagctctccaaggaccgtttccatctttggaagcctgatgagtgtggatacgtttccgcaggaaacaatggcatcctctttctcatctaaggaaaccagcggctgactggcaccgtctcttcccgtgcactcgtttgtaagtcctacggttttcacgcctgcattttccagggcaacgatacaagctgtaaaatctgcatccggattgccgtatccttcttccgcaacaatggcggaatccgctcccaggctctttgccatctgtgccacgaataaggcggctctttccttctgatccagggccacatttaagttggacatgatcactccaaggaaattaatggtctttccatgctccttataaagccttcggatcatgggaaggttctggaaatcataggtagcccacttggaagagcatggcataaaggatccgctgatcattgcaccatcaagcacctcattgggatgcatgaaggtgggaagcatccggttggtatcccagccgtaatttaagtcattatagccgccttcttccatctgagactgaggctgaagcaccagtaccacgcttggaagcttgtttacttcctcgcttctttttgtaaccggctccagctcaaaggtctctacctcatccggagtcaaatcctttgctgcagctccgatgtattcggcaaggcgcatacctgcccatcttaaagccctgttctttttctgctgttccttctgctcaaaaacctcatctgaatcagcaaccaataccagattttttaactgtgagaagtaggtgtatttggctccttctccgctcatatcgatcagcccatcctggaaaccgccgtagtgttttcctaccaccagaacgctcatatccttcagtgcataggtggttccgtttcctgcctgcaacagttcgccggtcactcccggaaataccgggcctccccctacgcggtagcggggctcaatggcctcttttacaggaacaagcctgacatgatccccaggcgatacaatatagagttctgcttccgtgatatgttcgtcttcttttattactgcaagagcttcttctttattcactgtaagaagtccgtcttttaaggaagtctgatcgccgaagcaaatatctttgacataaaaatttcccaattccagcttcattccatatctcctttcaaattaatactgaattaccgtcttggtcaagcggttaaaaaaatccgccgcctccaaaaggtcttcttcactcatggtccttacatcaagcagcaccttgtttttccagatccttgctataatgggaacggaattatttcgaagcatgctttccagcatatctgcagatacccgttccacgcttattcccactgcataagatgcaagattaacacccggcatggttcctccgccgatctgcccttctgtttccaacacctcaacctgtacccccggctgtttcaccagaagactgtgtaaatgctctgctttttcccttaaacgttccaaaggctctgtgatcattttcagggtagggatctgttccattgccgtttccggggacaaatactgcctgagagttaattccagggcgtttaaggtcagcttatcaatcctcagtgcccggagcagatgatttttcttcatctggttgatataacaggctttgcctactataatgccggcctgaggtccgccaagtagcttatctccgctgaagcatacgatatcggccctttgttccagacagtctttgaccgttggttcatcaccgatcccatacgcttttaagtcggccagcagccctgatcccagatcgtatatcaccggaagcccgtgcctttcccccaccgccttcatctgttccagagaaacctcctctgtaaagccgatgatcttataattgctggtgtggacctttaataatgctccggtattctcactgatgttatcttcataatctctttcatgggtcttgttggtggttcccacctctgtaagcctgcatccgctggctgtcataatttcaggaacccggaatgctccgcctatctccaccagctctccccttgaaacgatgacctcttttccctttgccatggaattcagcaccagatacacggctgccgcattgttgttgacaacaagggctgcctctgctccggtcaaaaaggtaagaagctgctccacatggtcgtacctggagcctctttcccccgtttccagatgatactccaggttggagtaagatccgctgatttccttcatgctttctgaaaccgtctgagaaagccttgctctccccagattggtatgaagcacgatgccggtcccgttgaccacccttctcagatggggctggttctgcctttcgatttcagccttgatccgtctgattaactcatcctttgagagctgacaggattctccggataatattttttgccgttccagctggatttccttttgacaggcaagttttatcaaaaccgccggagcatcagtgattccttctaaagccatggaacgcatcatttcatccactttaggcagctgcctcatgagactgtttttatctgtcatttttccgaacctctcaaattatttttcaaaccttcaaagctgtcctccggctgggtcagccgataaactgattgccggaaaggatctccctggcctttttaagattgtgttctgcaatgagaaccacaggccctgtacagcccattccgctctccgcataaataccggcagcccataaacaggaaaccgctgcttccagatccatgatctcaattccaaggatctcctctgttaccacttcctttggaggcgcttttatttcttctgccggccctgaatccttacctggctttatttcctccagaatctcagcaaggcctgccttctttgcctttgcaaactcctctgccataaccttctgataattgccgtcaaggagttcttttgcaaattcaatggcccctgtgaccagaggagttcccgatgcccttgatacaatgaggatcagcttatcaaacccttcaccgattcccggaccgtatccaaaaccaaccgactcatagctgcctcctgtggtataggcggaaaacacctttgtaaggacatttccggtgagagaatccatgaccattacatcagctgagcctgtcagtaagtcattgcctctcatgacaatgcctccatcagctctctgggaaagagcaaaccggatatcatatccatttttcttaagcttttgcagtgcaatctctgcctgacgggctccatccacatttaaaatacctacagtggggttttccaccccgcttgcctttgcggctatgatcccgtatacggcattctttaccatgctctccacccggttcacggatgacgttccagttgtggatgcaatatacatctgtttgccggccgctggcgtgatcacccggccaaccgtagagactccgatcgggaaaggatagtgcatggttactgccccgtaagcttcctggttcttaagcatgtcatccatttttttatgggcctcttcttccgaggcaaccggtatgacctccaggttttccgcttccattggtttggttccgattactttcacagatatcccttttttagccgctgcacgggctgcctgataaatggcctcttccccgtgctcactgcccatggcggtaactgcaataggcatctttttgccggcctggcctgtctcaagcatgtgagccatatccaaaaaggtctctgcgattatacgtttcatcttaccctctgacatacactcacccctcgtcttcctgaagatgctctgcaaaatcctttaaggcggctgcgatcagctttttgatcctttcctctgacacggtttcctcctggcctgcaccgctgttctgctgcaggataaaggacactccgtcaaagagattggtcatccttccaaggaacaggcttccctttccaataaacatagctttggtgattttcttatccatcagctcctgtctggcgaaaccaaggtaaggaaccgctgaggggatatgtccctgagtaggcgcccagcccaccatgccgtgctttgatacgaaatctgccagctgggatttttcaatctctttgcgcatggcggcaagagccctatcattttataatttgcctccggcacgttgccggcacctgcaggcttggtaatatccggattctgcatttccacggaatacttatcaatatctgtcagtttcagccctgctctttcaagagccgacgctgtcaaagaagaaatgacattctgaggagaggatccggttcccaccgtatgcctgcccacaatatccgtattgatctccgggctgatgccgtcgttggcactgatgagcacggcaaagccggccacacagtcttccagaatgggcatccccttgtttacgtgatcttttccattcattccaagctttgcggtagagcctccggcagcaacgatcacatgtttaaaggttcccgcttttaccaaagccgccgcatggatcagggcgtgggccggacctgcacaaaagccccttacatcagagcctgtggcattggtaagacctgcgatttcagccgctgcctttgcaaagtttcctccgcctctctggttcatatcaccgcacgcttcttccgaacactcaatcacatattcaatttcttcctttttgatatcattcttatccatcaaatgcagtaacgataaaacacaggaagcttttgaaacgagattttcaaaaatgacgtgggccgaaagggaatggtcaatatcatgtgctgctttgatgcagccgacagtagttccctggtaatacaaaggctccccgtgttcgtctgcgatcaaatggttgatttctgataattcaaagcttttatcaaagacttttaaaagcgatggatcaataaggctgtgagattctaattttttctttacggaatcagcaaactgaacttccagttttacaagatcaaacacatcgcagattgcgatcagaccgatgaattcatcctcaggcataatttctccaaacctgccttctctctgatcgtaatcggatttctgctgataccatggctgcgcataaccggccagttcatcaggcgtaacatttcctatgtaagtctggttcggcagatatgccttacactcttcataagaacgcagacttttatccagattttttaaatattccgaattcggatcaatggttctctgggtcgtctgtgttgtgccattatgaattaccatatccggcgtatgggcaaggatgtagcttgccccttttaagacgctgtacatattttgcctcctactgaatcaaattgacaggaagccctgttcatttgattttcaaattcaaggttgaaaaatgttttcacccctgcacctcatattaggtcctaataataaatcaattcctgcaaaatgcggtgccaatataccatttttattcaaacggaaaaactgggtcaccatttcacaagaattgatctgtgaagggatgaatgttaatatttacaatgctcgtcccttattgttgacatttcttttcggatatcatcaacatccaataccatttccatcatactgatctgctcgtcatagacatcgctgtccacttcatttttgatttccggctcacaagcatggtatacttttagtcccaactggactcctgccaatggtcctgcataagtagggtctcctgccgtaacagtttcagcagcaaggcctgcggcctcaccttctgcagctcctaaaacaacgataatgttttcagggccgtactgctccgccaaagtttttaccctcttttgattctccaggtccatagcacccgcagccgttcagacaaagcattctgttgacgaaaatactacttccgctccggctgttttaatacattgttcaattgccggaccaggaatgccgtctctgtcaccaataatgatgactttcttgtctttcagcattttattacctcctttttttatattataacgtgtgtccccaaggcagattgctccgctttgcagactgaaaacatcatgtgttccacgctatgttccaaatgattttcaaaaatcttaaaccggtgaggacaatgcatatttttttatcatttcttcgattctgtcaggcgttgcatcgtcttttaccagttcttccaccttttcaccgtttctatagatcgccatgaccggaagccccaggatcttctgggatatggcgagccttctggcctttgtggtattcagctttgtgaatttgatcttatcactgtactcctcggcaaatttctccacatgaggaagcagagccttgcatggctcacacccgtcaccgaaaaagtctacaaataccaccccttccgcttccagcacttctggtacaaaggtatccttatctacaaccagcatcttaatctcctcctttaattttctatatatttctcagccataacggctgcgatagccccatccgcacatgcggtgacaacctgtcttaagctcttcaccctgatatctccggcagcaaaaacacctggtatattggtttccatgttttcatttgttttgatatagccgtattccatatccagaatgccctcaaagcacttggactgaggcaggtatccgataaatccgaagattccgaaggtaccgtcctcctcatcggcagccacctccgtcacttctcctgtctttacgttttccacggacatactctggaccattccgtctccgtttatttcctttaccacggaatcccacataaaaccgattttaggattttcaaaagccttttcctgaatggatttagcggcccgaagctcatctcttctgtggattatggtcaccttccggccaaatttcgttaagtaaagggcctcttcaacggctgtatctcccccgccgaccacatagatctcaaaatcctcgaaaaagtttccatcacaagtagcacagtaagataccccttttccgatcaattccttttccccgggacagccgatgggctttggaaaagctcctgtggcaatgatcacggtttttgcatggtattctttttcttttccttttaataccttgatatctcctgaaaaatccacttcctgaatgcagtcggcagtccggtcgatcccgaatttctccacctgctttgtcatcctctgcaccagagaactgcctgattcctcgggaaggcatcccggataattctcgatctctgaagtaatgacgatctgtcccccatccttttccttctcgatcagcagggcattcagcctggctcttcctgcataaagtcctgcggacaatccggcaggccccccacctattattacaacatcgtaaatcttcaaggcgcacctccatttattttttagtatttaataccctgtcatctccctggcgtctggtaaacttctcctggtcaaaccgctccagaagcattaaggcaaacttcctgctggttccaatggaatccctgaagtccggaagctttaacacactgttttcatgaaaaagcctttctgccctttcctttgcctttttatactggtcttccgccaaaatatactgtccggggaggaccataaagccgtcctgcagcatgaattcaagcacctgctgcttttccctggcgttttccgtaagttctccggccgtaagaaatgtataaccgctttccagaatcttttcagccaattcagcctttactttcttttggccttccgtaagcgcaggctcaaagtcataacaagaaaccagattctgctccagcctcaccagatttttccctgccagatatttcagcatggtttcacattgctttttatgggataaatccagcttttccagaagttccgcctttggaattcctctccgcagccggttcttcttatgataatcgtttaaaatgtcctccaccatatatctgtaatgcatcaggtactctgcatgtatgtactgcttttctatgaatagtatggtttcatccgcttccagctcctttaattcctcttccttaatatccttatttaaaaaggcagcgatctgatcatgggtggaaaatggattatttttaatatattcttctatgatctccttggtagatgccgagtccttcatttgaagggactttagccgttcctcaggattatttttatatttcccggcctttggatcgataatgacccctccgccaatggttgtaaccggagaaatggttctgagcacaaaacggtcgccctttaaaacggctatttcatgatccagaagaatctgaccataaccatcatcccctgcctttacctttttatgggtgattggcacaaacctggccacttcctccgcagctcccacatagagctttaacttataaaaccttcccatttcaagctttgccgtctttacgatggaaaactttacatcgatcctgtctgttacgaacacgccgtcctttgttgcaaccgtatttcctctctttaattcatccactgcaacattggataagttgatggccgtccgctgccccgcataggctgattctacattatgttcatgaacctgaaggttccttaccttggtcacaataccctgaggataaaccaccaattcatcctcagcctttaataccccttccatcagggttccggtgactacggttccataccctttaacagaaaaaacccggtcaatgttcatccggggtttcttcgtaaagctccgctcccggatattggatgtcaggatctcaagctcccttatcaagtcgttaaaaccctttctgctgacagaatccacctcaacgatcttgctcccttctaaaaaggtcccctttataaaggattggatatcttcgatcaccagttctttaaattcctcatccaccaggtcgatttttgtgagcacgattaaaaatttttgtattcccaggtaactgagaatgtccatatgttccctggtctgaggcatgatgccctcatttgccgcaatgatgatgagagcggcgtcaatgcctgtggctccggccagcatgttcttaataaatctttcatgccccggaacatcaacaatgccaagagtacgcccattgggaagctgaaaaccggtaaatccaagattaatggaaatccctcttttcttttcctctgccagggtgtccgtatcatggcctgtgagagcttttaccaatgccgtttttccatggtcaatatgccctgccgttcctacaattatgctgtccattcatccctcacccagatcccatgtttgataaatttttaacaatatggtcgcaatttatgttaatggaaattatttttggcggaagcatatgggaatcgaacccacccacgacgattagccgcaacacggttttgaagaccggtaggcacaccagttacctgtctgcttccataaatattcagattgtagattgtctacaatctacttttatattataccattttttcctttcatatcaagaaagtgttttttatattatcaataccctttatttcatttttttataggtcagaaaaatttataggtgaaaacttataaaatacggaattatcaaaaacatttttagattaatttttataataaaaaaaacacaagcttaaaatcacttgtgtttttgcatattcattaattcaatttttttatctgcttcatccttgacaagtcctatgatatatcccatggtcccggcagcctcaagcctttttaataggaagccggcctcttcttcaggcagggaaatacacagacctcctgaggtttgggcatcagaagcaatatcaatcaatgcctgttccacatctggcataattttaacaaatgatttgatataatcaaaattccggtaagcgccggcaggcaccagcccggtaagtgccatttcctctgccaaaggaaacaggggaagtttatctgcaaaaacagatatggtaacttcactgcctgccgccatttcgtagaggtggcccagaagtccaaagcctgtgatatcggtgcatgcgtgaatggaaagtccctccatggctgcccctgcctcctgattcaatgcggccatgctctcaaacatgatctcacagtcctttggttctataaattccgctttcagggcggttaagaggatccctgaaccaataggcttggtcagaaccagcacatcaccaggttttgctcccacattcttccgcacctttcccggatggacgaatcccgtaacgcttaacccgtatttgggaaccttgtcctcaatggtatgacccccggttatgatgcatcctgcctttatagcctgatctgatcctccccgcaggatttcctttaccacctcatctcccagacaggggtttacgcaaaggagatttaaggctaacttaggtacccctcccatggcatagacatctgaaaaggcgttggcagccgcaattttgccgaataaataaggatcatccaccatgggcggaaaaaagtccgccgtctgtatgattgccatatcctcactgatctgatagacacaggcatcatccgccgtatcaaatccgacgatcaatgcaggatctgacagcttcggtaaatcgccgataatatttgaaagagctcccggccctaatttggccgctcagcccccgcctgatacgaactttgtgagcagtcctttctgctccatatagaacaccgcctttctgaaacccaatgacctttatcattttgtaccggctccctggcttcctatctgtctcccaggggcatataatcttcttcctgcatcacgctgatgtaggccggacggatgatcttatccatgttgatcagctcttcgatccggtgggcgctccagcccacgatccttgcaatggcaaagattggggtgaacaattcattgggaatatccagcatgctgtacacaaaaccgctgtaaaagtccacgttggcgcttacgcccttgtaaatctttctttcatccgcaattacctgaggcgccaggcgctcgatcatggaatagaggttaaaatcctccagacgccccttttcctctgataactgcttcacaaagcctttgaatatttctgcacggggatcggatttggaataaacagcatgtcccataccgtaaataagccctttcttgtcaaaggcttccttatgaagaagctttcttaagtaattctccacttcctcctcatcattccagtcccggacttcctttcgcaagtcatccatcatctccacgaccttaatgttggcgccgccatgcttgggcccctttaaagaagcaagggcagccgcaaccacgctgtatgtgtccgtaccggaggaagtgaccacgtgggtcgtaaaggtagagttgtttccgccaccatgctccatatgaaggatcagtgccaggtcgagaacatgggcttccaccttggagtacttcatgtccggccttaaaagccttaagatattttctgccgtggacaggttttcatccggcctgtggatatacatgctttctcctctgtcatagtggttgaatgcatggtatccgtaaaccgccagcatgggcataacgctgataagcatcaggctctgacgaagcacattgggaacggatatgtcgctggccttttcatcataagaggccaaagtcaggatgcttcttgcaagacaggacatcatatcctggctgggcgctttcatgacaacatctctgacaaagttggtgggcagggtccggctgtagcctaaggtcttggtaaaccgttccaactggctcttgtccggcagatctccaaaaagaaggagataggcgatttcctcaaaaccaaaacgcgcttctctcacaacgccgtttaccagatcatgaatgttatatccccggtaaaacagctggccttcacatgggaccttttgtccgtcttcgatcttgtttgataaaatctttgataccttggttaagcctgccacaacaccggctccgcttttatctctaagtccccgttttacctcaaatttctcataggcttccaggtcaatcttctcatcattcaaacagatatcagaccactcttccacatttttcaaaaattctttctggttcatcatgcaacacctctttctgaaatcaggtcatcgagttccactgctctcctcccattgggctttctaagcctgcttcatcccctttccttccttacaaaattctccaatcattcatgttagaacttttcaatataatatataattttatttaaaaaagcaagtaaatttttaagcatagtgatcatccctgtgtttccggctccgtcatatattgacaaactcccctctaaatcttatacttgccttaatttcctttagaggaatgtatcggaggttatccatgaaaattgaactttccctgtttttctttgtagaagccatcggaaccatcgcatttgcatcttccggagccatggttgccataaaaaaacggctggatcttcttggtgttattgtacttggtgttaccaccgccgtgggaggcggtatgttaagggatattatcataggaaatgtacctcctgccctttttaaggaccccatctatgtattgctggcctttataacggttatgcttttatttatcatcgtaaggcaaaaccagaagatcctggccgggcgttccatagaaacctatgaaaaggtcatgaacatatttgatgccatcggacttggtgcctttactgtagtgggaattgatacggcggtgctgtccggctatggggattaccatttcctcatcatctttttaggcgtcatcacaggagtgggcggcggcattctgcgggacattatggccggacaaactccttatgtactcagaaaacatatttatgcctgtgcttccattgcaggggcggtcatatatgcaacgcttatgagctgtataaatggcgacatcgccatgctgatcggcgcctgctctgtggttctgatccgccttttagcaacccgcttttgctggaatctgcctaccgcaacaaaaaattaatttccttaaggaggacccttatgaaccgttttctgcaatatactgctggaatcattttttccttctgccttatgatcgtgcttttattcacctccgtggaggcagccgtttactggttgccgggatattttgaaaaagaatatgccaaatataatgtgacccagtcagtttccatgacaatggaggatcttcttgacgtcaccggtgaaatgatgtcctatctgaggggtgacagagatgaccttcacgtggaaaccaccatgggaggcgtagaacgggagtttttcaacgccagggaaatcgcccatatggaggatgtccggggactgtttttaggcgccctttccatacgaagaggttgtctcatgatcatggccttatgcctgatccttctccttttactaaaaaccagctttaagaagacctttccccgggccgtgtgcgctggaaccggaatcttttttttcctgaccgctgtcatagccttcattatctcaacagattttacaagatattttatcctcttccaccatatattctttaaaaatgacttgtggatgctggatccttccactgatatgctcattaacatcgttccggaaggctttttccgggacacggtctttctcatcggctttatctaccttttctccatcctgcttattttcgccgcctgtctttttcttatgcgcagggaaaaaaataaagatctttaattcctgggttcgtgatcaaggggatatgtccgcgtatccccttgatttaccggcacgtaaatggggaaaaatactaaataatctttacttgttacggtaaataacctatactgtagattgaagtattgtctgaaactgaatcaaagcctatggagagattactcaatatgactcaatttacgaaaaagatttctatattttttctgtgcctgcttttttttatctcctcctttacaaggatttctctggctgcagcagattggccttccaacctttcagtccaggcccagggagccattttgatggatgcggatacagggaccgtcctttggggccagaacatacacagtgaatattttccagccagcattaccaaggtcatgaccgcactgattgttatcgaaaaatgcagtctggacgaaatcgtaaccttttcccataacgccgtatacaatgtggaatccggaagcagcaacgccggaatcaatgaaggggacaagctgtctgtgaaggactgcctttatgccctgctgcttaaatcagccaatgaatcagccaacgcccttgcagagcatgtggcaggaagcacggaagcctttgctgacatgatgaatgccaaggcaaaggaactgggatgcacaaacactcattttgccaatcccagcggattaaataacccggagcattatacttctccttacgacatggctctcattgcaagggcagcatttaacaatcctgtttttgaagagattgattccacaacctattataagcttccgcccaactccatcaataaagaagggcttaccatctatcctggccacaagatgatgcgcaaaagcacgccttactactatccgggcattgtaggaggcaaaaccggctacaccacgctggccggcaacaccctcataacctgtgcggaaaaaaagggattaaagctgattaccatcatcttaaaaggatcgactccccagtattggactgacaccaaaaatcttctggattttggttttgaaaattttgtttccttaaaagctgcggaatacgaaaaaacctacagctccattaccagcgacttaaatttcagcggattgtccatcaccaaaccggaggccctgatcctggaccctgacagccggatcatcctgcctaaaacagcaaatttttccgatgcaaagccggagctcagctatgatatttcatccggggacccgccaaatgccatcgcaaagataaactaccgttataatgaccgtgtggttggctgcactttcctggaggtgaatgaagccttattccagaacaagacacaggaagccggggcagccacggtacctcaggccgaaaccctctccgattccatggaggatttggatccgtccgccacccagacttccaccaagcctaccggaaggaatctggaaaaagaagcggaagattaccgggaaaaggctttaagaccctttgagatcccattagcagcctggcttattttaggaagtgtgggcgctgtggcagtgatcggaggggcagtcaccttctttctgtaccggaaacacagagaggagcaggatttccttatacggcgggaacagcgtatgaaacgcctccaggactccggggtctctgccgatgaattcaacagcattctggaacaaaggcgcagttcctattcatcaaagcggaaaggacggcggggcggccgtttcaaattccgttagctgcaaaaggagatttcatgaataaacagaaaatcatatccaaaaaggacttgcttcggaatttcattgtcacctttgtctgccttttatttgccaccgccctctcctacatgatgcacatactgggcgggtatactaacaacgtgggaatcatttatatgatggcagttgtattgatctcccgctattccagcggttatataccgggagtcattgcctcttttatcagtgtgatctgtgtaaactttgtgtttacttacccatatatggcgtttaactttgtaatggaaggatatcctgttactttcattgcactgctgatcatttcaactattacaagcaccactaccactcacttaaaagaacaaagccgtatcataaacgagcgggaaaagatgttaatggaggcggaaaaggaagccttacgggcaaacctcttgcgggccatttcccatgaccttcggacccctctcacagggatcatcggcgcaagcaacacatatctggaaaactccgtcaacatgcaggagtcagaaaagaccagcctggtttccaatatccgcgaagacgccaactggctcttaaatatggtggaaaacctgcttagcgttaccaggatacgggatacgggagctcatgtttcaaagcgtccggaaccattggaagaggttgcttccgaagccattgagcgttttcacaaaagactgcccaaatccgttgtccatgtgaccgtaccagatgagtttatcatggttcccatggatgccactttgatcgaacaggtcatcatcaaccttctggaaaatgctgtttaccattccaattcaaaggaacccatcagcctgtccatattcgttgaggatggttatgcctggtttgaggtgcgggaccagggtgtgggaatttccccggaacggctggacaccttatttgacggttatacctcatcgcccaacagcagctatgattcccataagggaatggggatcgggctttccatctgcaaggccattgttactgcccacgacggaaaaatcacagcagccaatgaagatcatggcgcagtttttacatttacactaccattaggggagaatgcttatgagtaagtttacaatcgtcatgattgaagacgaaaagaatatctgcaactttattgaaagcgctttagaaagacatgattataaagtaaatacggcctataacgggcgggatggactggccctgatcaattccctctgcccggatgtgattcttttggacttaggacttcctgacctggacggaattgatattataaaaagcgtccgaagctggacttccattccgattatagtcatttccgccaggacccaggaacacgaaaaggtagccgcccttgatttcggcgccgatgattatatcaccaagccctttggaaccagcgagctgctggccaggatccgcactgcccttcgccatggaaggcctaccgtcagcaccatggatggagctgtcatacccaccccctacagcagcgacggcctgtttattgattttgccaagcgtctggtcacacttgaagggcgcaaaatccatttgactcagatcgaatacaagctggtctcccttcttgcggaaaattccggcaaggtcctgacttatgactatatcataagccacatctggggccttacgcggataacaataaccagatcctccgggtcaatatggcccacatccgcagaaaaatagaaaacaatccggcggaaccaaaatatattttcacggaaatcggagtcggataccggatgaaggaaagcgaaacttaggaaagggggcatcccccttctttttattctgctttcgtatcttggtcttttccacccgtttttttctggtttcttcctttttctcgtagatctcccggatgtcttcctctcccaccagcctcatagtcttcaccacatagaccctgccgtcatcggtgcgcctcatgcggatctttccctttacatttccatgttcaggacagataccaagagccgtataaaacttctggttcacggaaaaccatctgattttctttctcagcatccggttgcacttgcagcaaatgacatcagtgacggttttgtccccaatggcatcctgctttgactcaaagggccttgaaatgtatttggagtaccttggaaacaccagatatacttcctcctccttattttccggcaggcggtaataatccgttgaccagtattcccggaccttatcaaagtccattttatgcataacacgcccggtgtaatgggcatcgtcaagggctcggtgaaagggcctctcttccatgatctgcatctctaaaaccgcaatatcaagggactgccggtctttgccatccccataaaggaggctgtaaagcttctgtacatcatagtagagaaagggctttggaaaggggtttatgattccataaaacgccatattcctctgcagctcggttaagtccatggaaccccaggtacagaatacggcttcctctccgcaccactttaaaaactcctttatggcttcctcaaagtccctgccttcttccatcagggttttttcatccatgtgggttacttccaatatcttttcatgaagttccggatagatcctgggccgtatcagtctcttaaattcacccacttcttccagcccttcattaagcttcacagccccgatctctatgatttcaaagggaaggcgctctaccgcctcttccttccctccggcactctggttccattccagatccagtacaatataattcttcatattctaatcctttattctgtcagacctctcagcttgtcacgaatcctctgcctgcgcctttccgtctcttccctctcaaatgtccatgtcccgtcttcctctgtgagaatgtctccttcctttacgccttccggcagcgcagaggcccggacctttaccatgtccccgttttcatcctcgcagatgacaagggtttctcctatcctgtctatggtaaccttcataacctttcctcttcctttctcccccagattaaggattgcagctttggcacggttcataccccattccgatcaattcctctctggccccctgataagccttccggttctcttttttcatggaggctgctgacttgcagtccggtctgtgaaatttcttcgtgttggtatttatcacataatcctggacagctgccgtactttgcgccctgtcctcacctgcatcttccccaattgccggaaaggtgacctttgatccgtcgctcaccgccacaatggtcccaagctgatccgtgcgcaaagctttgatgttccgcttctttagcatctccaggatctccctgtgaggatgcccataatcattatttttaccgcaggagatcaccgcatattccggatccaccttatccataaagcccggagcggatgaggtggagcttccatgatgggaaagcttcagcacatcggcctttaaggggagaccgcctgctgccatatcctcttccgcttccttttccgcatctccgcataaaacaaagctgttctttccataaaccagccgcaggcctatggaccagttattcaaattatctccatagtccctgacgggagctatgatctgaaatgaagcctccccaagggaataaccatccccggctttggaatggtgacttttaaacctttatccgctatggcatctaacaatcgctcataaaccttcgtagtgtgttctttttccggcaaaaggaccttctgaacgccgaatttccggataaccgtctccaggccgccgatgtggtctgaatggggatgggttccgatcacatagtccagcgtcttcactccctgtttctccagataggaggcaacaatctctccctgatcccgctctcctgcgtctatgagcatgaaatgcccgtctttttcaattaatgtgctgtctccctggcccacgtcaataaaatgtacctttaaatccgcgcctgcctcatttccctgagggaatggggaaggatctgcggctgccgggctgcagcctgccaagaaaagagttaataggacaacggctgccgccagtacccgttggtaacgctttcccgtctttttttctgtcattcttatctgcctccgccctgttattatatgatataatccttaatcctacaagtttttttaaaagcaggggccctcagacggcaaaaaagcggaccgcaaaaagcagcccgccaattcatctttaaatccttaaggaagctttgctccgtcggctccgaccctgactccgtcaggggttgtggtgtttgaaagcatctgtcctcctgcaagatcgcagtaatactgctttccgttccactcaacccaccctgtagccatatagccccttgcgttgaagaaataccactgtccatcgatactctgccagatttctgccggataggttccgtcgttgttggcataccaccagccggttccatcctgcttccatccccactgttcccggaagaggtgcggttttgttcagctgccgccgcatccacgtagttggcggaagactccacccaatcacctttattctcagagttctgcttactcaccgggcgcaccttaaaggtgtagttccccacctttcccattgacccggaaagatccagactcgttcccacggaggtcttaacccctcccgtatgctttccgtcacggtacagcttcacttcatagcttccggctcctgctgcaggactccatactgccatggttttagaaccccactctgcacttgttatgtcctgggtaaattctcccaccctgggaagatcaatggtcaatgtcagcgtctggctgaaatcttcccttgcctgctttacgaaggttcccccactaatggtgaaaccagactcagaaactgaaaaataatatccttcctgtgcatacagctttacttccagccttggcacatcatgctcataccactgaaatccgctgttggtaaattcatattctcccacatcaattttgccgttttttactgtgagctcagcctgctggtcaaaaacggaacctcccggcaccacatccgcagacacggacaagttcaccgtagtgatcttctttctggtggcagccatagaagtcatgctgttaagccctgctgccattgtaacagcaagtaccagtgataagattcttttaccattcataaacgatccccgtctttctttcttaaatttcaaattactgcgcaatagaattattataccctattcccggacgtttgtgaataccattctcttttccggaggctttcccggatattccagaacgcaaatacctgattaaaggcctggtatctgtttccaattgtggatgagcagtgtgttacaagatttttgttgtttataaagtatatttttattcatattttaatctactttttatagaagttaattcatatctttttgtatttgttaataatatatcaaaaattaaccaaatttataatgctttatcgcaaatatatattgcattataaccattaatatgataaactaacgtcaatgaaacatttgctagagaaaaagagagagcagacgttacatttccgccattatctctaaggcggagtgtaatgctggttctctttttctttttaggaaaaggaggataagtttttcatgaaaaagaagcgatttttccgggtgattgagccatatctgtatctattgcccgccatgtttttctttacggcattcctgttttggccgttctttaaaaccatttggctcagttttgccatgacaactccccttggggcggtttcctcccttgtgggccttgggaattatcttaccatcttcacctcccaggccttccaaaacagtcttctggtttcctttcaatacgcagttatgaccgtggtctgttctattgtcatcgggtttgtcctggcaatcataagcaatgaggatattaaaggaaaaaacctgttcaggaccatttatgctcttcccatggcaatttccgctgcggctgcttccgttgtttttatgttcatttttcacagcagtcttggaattataaacaagatcctgggtacccacatcggctggctgacggatcccaagtacgccctgggcgctgtcacccttgtgaccgtatggatgaacatcggattaaactttatattccttaccgccgccttgcaaagcgttcccttagacttatatgaatgcgcggccattgaaggagccggcttttatgccaagcacaggcacattactattccatgcatatcgcctaccctgtttttccttttgatcatcaatgtcatcaatgcccttcaggcttacgctcaggttaagatgatgacacagggcgggccttccggaagcaccaatgtcattgtgtatcagatctatcaggaggcctttataaacagccggttcggtatggcctgcgcggaatccatcgtcttgtttgtaattctgatggttctcactttgcttcaatttaaactggaaaagaaggtgacctactgatgaaaaacaaactggttaaatatttgctttatgctttaaatatcctttttgcaatcatcatcatatcgcctgttgtctactgctttaacgtgagcatgatgaccatgaaggaggtattttccggcggcttctggccaaagcagctgatccctgataattacataaaagccctgcagctggctcctttttttacctttataaaaaactccttaatcgtgtccggtacagttacttttggacagatcgccacaggagcgctggctgcctatgctttttccatgatgaaattccgcggccgtaatgttctgtttttgctgatgcttgcaaccatgatgatccccagccaggccatcatcattgcaaattacttaatcatctgcgacttaggccttaagaacacctatacggccctgatccttccaaacgttgcttctgcttttgcagtgtttaacatgaggcaggcgttcctccagcttcccatggagatcaaagaggctgcggatattgacggctgcagcaacttccggttcttctgctttatcgcccttccgcttgtaaagccctccatgggcgcactgggtatttacatattccttcaaagctggaatcactatttatggcccctgcttgtaacggattcagtgaacatgagaaccgttcagatcggccttggtatgcttcagggcgcggaatccacggacttccgtccggtcatggccggttccatgatcatcctgattccctccatcctggcgttcgtattaggtcagaagcaattgatttccggcctcacctcaggttctgtaaaagggtaagtattttatgcaggcccaacagggactgtgtatagataaaactatataattaaagactaactattaaaagtcaagtctaaaaaagaaagtttatgaatgaattgcagaaatgcatttcaagtaaatcagtaccttgaaaaccgcatgacaaacagagcatctttacaggtgctcaaaaagaaaattattaaacagaaaagttaagagactttgttgtatgcctgtcccgatttttctaaccgataaatgactctgaccagcttcttcgcagcatgagaaacagcaacgttataatgcttaccctccgccctcttttttgcaagataggcggcaaataccggatcccacttacagacaaatttagcagcattaaaaagtgcgtagcgcagatacctggaaccacgcttttccatatgtgaatgagaagattccaactgtccggattggtaggtagagggagataatccagcataggcaagaatcttatcaggagagtcaaaacgggaaaaatcaccgatttcagctagaatcatggcgcccatccggtaactgattccaggaatcgtaagaataggggaatggagttcatccatgatacgttttatttcctgttcgatttcatcaatttcggcatctaattcacctatcagctttagggtgtgtttcagttccagagattttacaggcatattcgaaccgatagaggctctggctgtttccctgaacaggatggcgttgtctctgccgtaacgacccttagaggtttcgtaaagcagattggtcagtctggtaagatgagcagaagcaatctgaaaagcaccggggaattcgcttagtaaagcggaaatggaaggcatatgaagagtgggaaccagcttttccagttcaggaaaaagaatcgtaaccagacgggaaacagaagttttaagcttggcgcgctccctgactttatcaaaacggtaacgggttagtgactttaattcctcgttgtggtaagatatgtctgagtaggactttaagttcacatcagacataagcattgtagcaatcgtatgggaatcaactttatccgttttcgtctttctaaggcttagactttttctgaaaagactggtatgtaacggattgataacaaaggtggtcagacctttatcaagaagaaagcccaagatgttataactgtagtgtccagtggcttcaaggcctacttttacattggttaaatcatctgtagtggaagtgatcttctgatagaggacctcaaaaccttcccggttgttgggaatggtaaaggatttaaagagaatcttcccatctgagttgatgataaaacaatcatgcttatccttggaaacatcaatccctgcgtatatcatagcgaaactcctattaaatgaatttgatactgttttagaccacggtggctctctgcgattgtaaccttgttctaaataaaccgtcatgcggtatctaactgattaacaagtgaacaaagagactgtggttagagcctttactaaaccatcaagtggtaggagaaatgaactaatccacagtatctaaaacagcatagctcatacctaagaaaaggtaaagaaaagctatgactatataatacaaggaggatttatatgaaaagaagaaaaagatggcttgcggcagctatggccgcagtcatgtccatgactctggctgcttgcggaggaagtgcttccacttccgggggaaccacagcggcaggttctacagaagccgctacaacaaaagctgcggctgacacaaaagctccggctgaaggcggaaagacggtcatcaccctctggcatgccatgggaggcgtaaacggagaggcgaccgaagcccttgtcaaggcctttaacgaatcccagagtgaggtggaggtaaaaagtgagtaccagggaacatatgacgacttaatcaccaagctgaaagctgccatgcagagcggcaacatgccggacgtctgccaaatgtacgacatcggtacaaagttcatgactgacagcggctatgccgttccggtacaggatatgttttccaccacaaactttgatccttccaccgttatggacatcattaccagctattacaccgtaaacggaaaacagatgtccatgccgtttaacgtttccactccaatgctgtactacaacaaggatgttttcaaggctgccggtttagatcccgacaccccgcctaagacatttgacgaggttttggaattctccaagaaaatcgtggaaagcaaggctgccccggtaggctatgcccaggccatttacggctggttctttgagcagcagatcgcgggacagggaaaattctatgcaaacaatgagaacgggcggaaagatcctgccacggaagtggatttcttaaacaacggagcaggacttaagatttttgaaacctggaaaaaactcatggattccggatatgcggcaaactacggaagcaccaccgcagatacccagaccgcattcttttccggtcagactgccatgatcattgagtccacggcaatccttaaaaatgctacggccagcagcgattttgagatcggtaccggatatcttccaaagatcgatgcaagtgctgccgacggcggcgtaatcatcggaggcgcctccttatggatgatggataacaaggatgaagcgaaaaagaacgccgcctggaagttcattgaattcaccaccacaccggaatcccaggccacttggagcatgtccaccggttactttgcagttaaccccaaggcttatgaaactcctgccatgaaggatttcattgcccagaatccaaacttcaccacagctatcaaccagttaaaggatactcctgtcaacggatacaccgcaggcgtattatccggagtcgctaccgaatccagaacactctttaacgaagcaatggaaaaaacctatgacggcacctacacaccggatcaggcggtaaatttcctggctgaaaaggtaaatgcagccattacaaactacaattcatccataaaataatgataaaaaagatctggggaccggctgattatcatcagccggtccccagatcttttttatgctttcagaatttaacaatagggttcaagaaacgccccgccggcctttaatgtttccctaagctgtaccacgtcaatagcagccacgctgattccctgtccagctgcaagagcagccgcagtgccggccccttcactgatggccataagtatgggagtcactcggacggccgcacaggcttcgtgtgttgcactcatgcagcgtccggtcaccagtaagttatccagctcattggtatacaggcagcggtaaggaatggaataccagcttccctcttttaaataatgatgctccatcgtcccccgtcaggcgaatggatatcaatggggtagccgcccatggcgattgcgtcctcaaacatcttattttgaagcagatcggtagcagtcagcttatatgcgccgttgatcttgcggctttctctgacgccgatatgaggtcctgtggaaacaatcactgcctgttcaaatccaggtatatattttttcatgaaattcacaatgatatgagcctgtcttcttccctctatctccgcctctgttaaatcaaaggaatccactgcgcttcttctcacgatacgggacatgttaaggatgtattctcccagattatttgtctcaaagcacagcaccatatccctgtcaatgggaaattcccctgcttccctggcctttcttacaacggaatatgctccctgcacgccgcttcttgggatcagctccagacggtcaaagggaatggttgaaagcatgtcatccgaatgcccttttacatattcaatgacccgttcccgatccacgttccgcaccttgatgttcatggtcattggctgggcgagatgatcctcttcccttccgtagacgctttcaactccgacatgggtcgcaagatctccgtctgccgaagcgtcaatgaaaaccgatccggtcacggtaaagaacccctgtttcccatacaaatgcacgccggtgattttccggccttcccgctcacagcctgtgtaaacggtgtgatacaaaagatcggccccggattcccggaccatggtctctaaaaccagtttcattccttccgcatcaaaaggggttatagaactggcataccccacaaaatcctccatatggcccggagaaaagccctcttttaccattcgttccacgatctcctctgcaactcccctcacaacctgtgtgctgcctgcatgaaaggtcatctgtgggccagtgcctgccatggtaagcatccctcccagacaaccgttctgctccacaagaagcgttctggccccgtttctggcgctggcaatggccgcggcagttcctgccggaccgccgccgatgatcaccacatcataattcaagtcctgtttcatataccttctcctctcttcttttcttccttttttatcaaggtatcccgggtgttttctctttcctgccccttattgggagtatgaagctaatcctgaggggtgtttgccagctggtaatagcggcaggcaaacccatgagccccgatctccgacaaggccctgattccggtccgcccgatttttaaaccgcccagcttcaacataggcacctggtaatccttgctggtcagtcccagctcattccattccagaaaatgatagtattcatggctcaatatcaggtttactgcctcatctgtctccattccgttttcctctgcccagagtgaaatggatttcatatagaggtggatcagcttctgccctgttaaataatcgctgaagtatctctgatttcccatgacataatccgtatcgatcttttcataagtaaggccgctttcttcaacaattttcgtaaaatccttttctccccggtaacgcttaaaaaccagttcagccgccttcattccttttaaccaggctttgtctgtgatgaccggtctgtcacattcaggaaccttgctgcagcagctgtcacggctcagctcttcttccgccagctccctgccgggaaaaggcatggaaattttattcaaggtctttcaccgcctatctgttcttcctcattttcctcgcagctttatgaatctgcccttttcgttgccacaatcagaatcttttcctctttgtcaaagcccgtaagctctgcatttcccaggccgcagatctgctctctgttctgaaggccggacagatcaatgatgcgttttcctgataccagataaatattgggaagattggcgccgccgtcattaaacacggtcagttcttccagaaaccagtcagcctttgcctcccaatcttttatcttcgtctcagcagccattgcattgtttttctgcaggcggatgaccccttcttcatcgatcaggcgcaaaggagtggtggtggtcttcaccagacccagtaattttctttccacctttttatactgaaccgcatacatgcggccgttctcagccgttacggacagttcatcaggagccactgacagattttccgcagacagctttaaaagctctttcactgacagctttgcactgcccagggttttgcttctcatttccgtagccccaacagcaatcgcccttacaagatttttctgggtatcaacgtccacatgaatctcaatagtaccaggcgcggcgccgctttgtatggctttctgctccgcttccctgcggatgcttaaaatatcttcctgggtgggatttgaaaccgttcgttccaccatatcccggaccatggccaaagccacgccaatggtggaaatgaccgccgcattgccagcgatccggcatttatgcttcagggtttcggccagatgaggcactacgccggccgcccctccgcctccgcctacaaaaaccgtctgctctggctgcattttataatccttcatcagctgctccgccacttttgcattttttgccgctgcaaaagccattaccttttttgcagcttcctccacggtgcagcccatgttttcggccagaggcttccaggcctttctggcagcttccacattcccataggcgtaatcctccggcttcacataaccggcaatgttggctgccccggccatggtcagggtgaccctcactccgttgtcgcatacgatcaccgcgtaatccggatcggttggcaccggcctgatggtctcaagccttggattccggatcaggccggcatccgtatagacttcataatccagtcctgctatatgggcgcttctgggccccatatccaccggctttccatcctttatctggaccatgcttccgcctccgattcccacggtcctcacatccaggctgtttaaataggttttatgtccccctacctcggcgtactggatcatgaccttgccatccttcacacaagaaatatccgttgatgtaccgccgacttcaaaaaacaggccatcagtcagcttttcatacataagcgctccggcaacaccggctgccggccctgaaagaattgtcataatgggtcggtttctcacctcatctacagtcataaccccgccgtcgcagcgcatgaccataagcgggcttttgatccctgcgtccttaatgcttttttccgtcatagtggcagcttccagcattttaggcataatgctggcattcaccacggcagtcctggtccttatttttaaaccgtacagcttggagatctcattggtagcggtccccggaatttccatcctcctgcacatttccagagccatgttttcattgcccggatcatccacgctgaacgcttctgccgcaacaatgcttgaagcgccccgctccaataaggaattgatggcgttttcaatggtgctttccagtttttccgcctctgatgtatccgcataaacattctggctcaccagaaatttacccgctgccagttcaatgtttccgatgtttgtatctgatttgctctttactccctgcaagccgcttccaagggttacaatgcccacagaagccacatccccttccagcagggcattggtcgcctgggtcgtgccgtgagcgataaaaaccacgtcctccggactgatgctgcaatcttccatgattttctgcagcgcctgtacaattccttccgccacgcccctggaagaattgtgggtggtcggcgtttttacaacgccgaccagctcaaaagtttcattatcaatggcaactgcatccgtaaatgtgccgccgacatcaattccgatacgtactttcataaaataaaatctcctgtctgaatgcttagaagtatataaatgctgaaataataacgcccatcaccgaaactgtccaaaggtatggaagcagcttttttgttatggtgttcacatccacctcggcgaaatttgcggtccagacgttctgggtattggtaggatctccgcagccctgtattctttccgctgacagaaacgcgcccatgactgcctggggatttaatgttccaaggccaatgactaaggcagcaattccagaaccaagtccgaataagttcatgggacctctgtataaagataagggagccaggatgctgaaaaagatgatgtatccgactttcgatgaaggaactaccgcaatcagaaacggattcagcacttcttttaccatggcatgggtcaccgcaagatataagataccaatgccgatcattaaaatgattgcaggagctccatccgtgatcccgtcatagcaggtttttaccagaagattcattgcctttgaaaagctcttggaggtaaataccaggatccataatataccggccagaaaggatggaactacaggaaccttaaaaaacgccaccagaacaatcggtataagaggggtgatcatggcaagccctccggacattcctctgagctgcttggtctgtgcctgatcggagactggtgcggaaaaagcaaacttgacaccgtttttcttaaattcaacaaagatcagaacaatggtggctgccagggtaagtaccagcatatagatctcaaacccttttatctgggcgatctccagaccgaatatgctggaaaaggaggtccagttggcaatgttaaagcagagccctacggcaaatgccatcaaaaatatgcttgctgcgctgactgccgggacacccacggaaatcagaataggcagcacaatggttcccaccatgatgacggagcccagaccgcttaaagttgtaaacaaaagcgctaccgccgttaccatgatcagggttacaatcagaggtctgtcgcctcccagctccgcactctttttaatgatattctcagttacccctgtcttgttcatcagctggcccagccatgcgccgaaaataacggccatgatagctgatcccattcgaaccgtaccggcctccaaaacagtggaaagccagccgatctgagccccttccccattcacacccacggcaggaactcctgcgatcacgcaaatgacaacagccaaaagcggcagagccagcagggtgggcaatttctttgccatcatgaatgctgcaataataagaaaagcaatgatgattaatgttccctgtaacatatgtttttcctccatattccccaaaataatatttataatttatcgactgcatttttaaattgtattgttgcagcttttacctgatccgctgtgggatcttttcccataactattgctccgatcatgacggctttgcagccggcttcataaagatgtctgacttcctcaggacggatttttttctgggtgggaatcagcgttggcttccctgccttggcagatatatccgtataacggagaatatcaccgtaatttaacggagttccgtaaagctcccccggctggatgctgcattccagtatatcaatgccggataaacgcaccccatccagcgtattttgattataagtgcagtcaatcgcagccattttggtcagtaccttgctttccatcatataacacggcagatggtgtatgtaagaagaaaagaaacaaagccccatttcttccgcttccagcctttcctcattggtaataaatgcttcttcccctcccggaaccagccctacaggcacctccccgcagagttctattaaatcttttaaaaaccggcggttttcttcatatgtcccgaaagtatgaccgctggcccggtgccatacatttgcatgaaccttgattgcctgcgctcctccttccagcgcagctctggccagctccagattattttccggaaggcttacaaccagagtgaatttgttttcatttaccattgacttaaaatccattgacttctcctttccaggtcgcagctgacggttggccgtccggcagctacatttcataaatcacttttttcagcactcgcttgcctaaatctgtttccatatggttaatcacgggctttattgccctgacttcaacagcgtgttttaataaacgttttttcttcagctgaccgcttacgcgctttgcaaggtcatctccttctgtcagcctgcctgataagtatacattttcaataggaaacagcatgcagatcatctgcagtatattgacaattccttctgtcagtctgtcaccggttattttcttatcttctgtttccacaaacggagtcatatccgccttttttcctgaagtcatatccagaagcgtcccattggcagttatggatacaaataccttttttccgatttcaatatgggcgctgttggcgctctcttctctttccagtatctgccggaaggaatagacctgggaatattcctctataacaggcaccttaaactgggtcttgaccgcttcacagaacgaaatggtgtcagaagacaaggatgtggaatacatgacattaaaatcactgggattcatgtcttcctgaaaaagcaggccgattccggccagctggccattgcagagatttcccgcatcctcctttaaatactgaatgactttttccagcagctcattgcccgtaatataataatccgacagaagaacactgtcgcttttttccagggaaagatccataaaatgaagcacagcccttctccaaccgatttccagaacagcaatataccctttgtttttattaattgacagttccgtcctctttctgcctcccgtggaagcggcaataccgctttcttcgatccagcccttttccatcaattctgaagtcagagaggataccgtgctgggtgaaagccctatgatctcggataattcaatgcgggaaactgattccttttccagtatcacgctcatgatcaaccgcagattttcccttttcatgtcctgtaaaccactttttttcatgttaagacagcaccctccttcttttttcggtctccgaaataagtatgtaatttaaaaatattccatttgcacgaaaatgtcaatcgattattttttttctctggtattttaggcataatgcatagattttattttttattttgtaaaaaacctccaagtactcagctgttgttttccctcacttttctgcctaaaatcgatcttccgggacaaaaaatattccaaatagtctgtatagttaaaaaaataaccgaaagattcttattgatttcctaaaattttccgatatatatggtagaatacaaagcattctccggcctgtatatttcataggctgaaaaatcgggaaaggaacgataaaatgaaaaaacagaatacaaatgctgaggatagccgcagagaaacaggttctctgattaaaaacctatctatcagcaaaaagctgattttaggcttcggtgtcatgctcctgatcattatagcatccaccgctctgtctgcctgggacacgaaaaagatcgggtttcaggttgaacgctattaccgctacaccgtaccaaataccaacagcacatggaccatgaggtccggccttgcctcagcgcaaaaatatcttttgcaggcgattcttgatgatgatgcacaggccgtacaggacaacctgaccaaggctcaggaacaggaagacagcgtttccgccgcactggaggcctttgcaggcaaccagtcatccaacgcaagggataacgacattgcgcagctaagagatttgttatcaacggccaaggcggcaagagaagagatttcaggactggttaccgcttcttccagcggaaacggcagcaaagcctatgaatcctataaaatcacttattcagccgcaattgatcaggccggtgagatcctgacgaacttttcaaatatccagctgcagtttgccaccgcccaaaaacaggaagcacaaaacttcatgaaaacagcctggttcgccctttccttatcccttttaatctccctgctgtttactcttttcattacagtgatcctcagaaaatccattctggatcctgtaaaggaaatcgagcttgtttacagggaaatggcaaaaggcaatttacaggctcagattacatatgaaggccaggatgagcttggaagcatggctgaaaatatcagaaatacaaatgcaaccatcacctcctatatcagggacattacggagaagctgaatcttctgtcacagggagatatgcgtttttccatggacctggactatgtaggagattttgaagcaattaaaaaagcaattttaaagaccgtttcctctttgaaccacaccctcatcatgattgatgttgccgcagagcaggttaatacaggaacagaacaggtgtccgcaggagcccagcagctggcagccggttccacagagcaggccgcttccgtagaggaactgtcctcctccattgccagtatcacggaacaggccgcggagaattcaaaaaatgttataaaagccaccgagtatgtaaagcagacaagtgataatgtgaaaaacggcggcactcatatgaagcagctcacaaaggcaatggacaacatcagcgtcttttccgatcagatcaccaatataacaaaggtcatcgaggacattgcattccagaccaacatcctttcccttaacgccgccattgaggctgcccgggctggaaccgcaggaaaaggcttttccgtggtagctgacgaggtccgcaaccttgcatccaaatccgcagaggccgccaagcagacggcagagctcatacaaaattccgtccatgctgtagaggagggcactgaaattacccaaaaaaccgcacagatcctggcggatattgaccggaccaccggttctatcaacgatatcgtcaataagatcaacgtatcagcctctgaacaggcttcttccattgagcagatccgtatagggctggagcaggtatccgctgtcatacaggccaatgcagcaactgcagaggaaaactcagcctccagcgaggaaatgagcgcccaggccaataccctgcgggaagaagtaggcaaattccacctggaaacagaacaaaaacaagaaaaagaaaccatacaaaataccccaaagcacgaatttgacaccgtgacagatccggtctatcaaaagtattaaggaaagcaaacggtcaggcaaatatattggttataaaataatcaagggcagccgcaaaacagatgattattatctgttttgcggctgccctcattttcacgttctaacatccgccgccggcgaattcagccagaaccttattgaactcatccttttggtcatagaaagccccatggccgctgaattcaaagggtaccagcctggaatttttaatgtattgatgctggatctcacccaatgaataaggcactatctgatcatggattccgtggatgatcagggtcggaacactgatcgcatccagatccgagaataatacctcccggagccaggtatttgcaacagccgcagttgcccagcctgccgcctgtaagcctaattggaagaaccattgggaaaaaggctcggtaatatgctggaaaaagaacatatttccaaaatcattcagcatgctgggacggtctgcgtaggtaccgtctatgatctgaatcactgcctccttatcaagcccataaggaaaatcagggcgcttaataaggcttggagctgctgccgcaaacaaggcaagccttgagactccgtaacccctgtgccttgccatgtaccgaacagcgatcgcccctcctgtggaatggcctgccagggtaatgtcctttagattcagcacatcaatgaccgctcttacatcatctgccaggcggtcataatcatacccgcaaaatggcttatcggaatttccaaatccccttgtatctatgccgatgcagcgaaagcccatctttggaaggacatcaaactgatattcaaaaagcttatggcttcccggccatccatggagaaataaaattgtttttttgcagtccggattaagatcttccacgtatatgttcacattcttttcaacggttatatagtatcccatgatctcacttctgcacattatgtttaatctatgctattccctctaaaaagccatggttccgtttttttaaattttagttaaaaaatcatccccggccagatggcggaagaaaaatgagccgtttcataataggcatcgctttctcaaaatcactcataatttcctccttttatctgctgcatcttcctgttccttttcctgaaaaagaagatgaaggttacagtgcctttgtaaagaattcaggccctgcatgataaaattccatgtttcatgaaagtcccccgaaactgcaaacccgccgtttgaaagaaatgcctgaaaccccttctgatccgaaccataccggtctgcaaaggcatctgcatagcttatcttttcatcatcagtcagatcctcactactattatgaagcacatgctcaagattccgggaaaaataataaatggaatagggaattctgccaaccgcatcagccgcgaagagacggtgcagcacctgagactttctcttattccggtcaatgatccggtcagggtccggggactcgatcctgtcatcaaagtacttaacaactcccgccttgccgccaaggacccggtcctccggaataaaggctccgtcaaggtccacaagatggatcaccttcataatgtctcttttctcaattccgtaccgctttcgttccacctcaatatgttcataaacggtttttaaggcattggctcctgatacagaccagttgcttgtcatatcaccgtgaaccacatgaaagcggacatcttccctttgaaatatctttttaaaaaccgggctgagggtctcctcgtccgtgggtccttccaccacaaacaggatcaccttcctagttttggcccccatctcccaccgcctttccggcgcgccggaacgcacggccaatttctacgctgtcggtttcctcataaacagtttccttttgaccgcctaatataatgctccgcaaatacatatcccgcaaattgtgattgctcttgatattctgcagacggatataccggttggaagggtttgtggtggaaaagacaatgctgtttttattgagcatttccagtgcacgcagattatgagatgtaaaaatcagctgtccctttgcccctttttcaaaaacagaaagcagttctcctaacagatactcatatacgccggaatccaattcgtcaataattaaacacatggaggcattattataaacgcacatgagggcatttaaaacggaaacgatcttaatgatcccctctgactcatattttaagggaattatgatgtctccccgttttgaaatcagttcaaccttatggcctgtctctccccattcaagaagctgccggccaaggtcgtaaatcccgatggaaaggccggggattatggtatcaaggaccacattcatctcatggatgatctgctgcgccatttgaaagtgctccttgctgattactgacggctcatcaagccttatgagcaagtctccctttgcgatcctctccccaaggtctaagcggaaggcaaaggggatcatgaaatccatgctgatggctccggcatgggcactggaaatcacaaacagattcatgcctgcgtattgataaagagcttcaatgataaaagcataatcctcagacgcaccgtctgcagcggataaaaataccggcctgccttccggaccgaagataaaggaaacaaggtctttccgggcaattttttttgcaacacttaagttgactttattttcgtcattttcccgcactaaagcttccagacggtatttgggcgtaaatatgatcccatccgaatgcagatcataatcgatcacggtttttttgctctcaaacctctctccgttccaggccgccccggagagaatctcgcggatgatttcaaactcattttttgaatttctctttaattggacggaatactctgccatggcttttttgctgtctgtctgaatgacaaacttaaccgtaattgtgcaggtctcctcttctttggaaatatagtggaccgtttcctttgataagggcagccccgtcagcaaagcctggataaaccccatggcctcgatcaccgctgtttttcccgaaccattctggccgtaaatgcccagaatatccgctgtctttgaaaaaaaatccttatttccggcagacggcatgacaatccgtccgtattgggtattcttaaatccctttaattcaatttcacttatgcgaaccgcagcctgaatcactttttcatcagctcctttcctgatcaaagattaacatgacccataaaaaatgtaaatattttcgaataacgatacattttatttcgatatggggtattatgatccataaaaaggcataatattcaaagcatctttaatcttccccctcaattgtcaccaccacccggttgggcaggcagacaatcagttccccgctcttgtggatctttcccgttcggacacacaccttatcagggcaggaagcatccgtaatgctggcgtagccgtccttgatgacaagatgatccgtacctccatatccctcaatgatcatatccacgtccttatgaagatccagggtttccacagtcttgccgtctacggtaactaccacctgctccgccggttttctgtttccggcataaaatactgcagaaagcaatcccgctatgaccaaaatagcggcaataaggatcagctctcttttttgtatgattgtcagtttctttaaatgattcaaattcgtcacctcatatttctcttaaatgtcctgaacttttattatagcatgtccgttctgtttataaaataagaaaagaggaaatagatatatcagaggtatatttttaacaaagtttacgaagtaagggaaacggccggaatgatcacagaaaatcatgacaaaaccgccttattccgtcatttttaatgcttagaaaaaaagatggaacagcaaaacggttacaggaaaagaacccatcagaaattgatgtgggaaaaattatcgttttgtgataaaattctggtaaaaataatgctcatatgttataataatgtcaaagtggcgttttgtgagccgctatcacacaaggaggggaagacttgaagaaaatagtagtgctgggtgccggttatgccggtattttaactgccaaaaaactggaaaaaaagttccgcaagatgaaaatggacaatgaggtaagtatttccatcattgacaggcatccattccataccatgctcacggagcttcacgaggtggccgctggaagggtggaagaagacagtatccgcatcagcttgaaaaaagtatttgcaggcaggaatgtggagatcatcacagacaccatcagccagatttccgttgaggagaaaaaactgaagggaagccagggcgaatatgattacgactatctgatcctggccgccggctccaaacccacctttttcggtgtggagggcgcagaggagtattcttataagctttggtcctatgaagatgctatgttattaaaagagcggatccagcaggtgttccgcaaagcggcctgtgagccggacgaggcggaaaagcgccgccttttgacgttctacgtggtaggcgccggttttaccggtgtggaaatggctggagaactggcagaatacgtgcccttcctctgtgaagagtatgagatcgatccgtctcttgtttccatgtttgacgtggatattttaagccgcacagtgcccatccttccggagaagctgtccggcaaggtagaaagacgccttgagaaaatgggcgttaaggtaatgatggaaaccggtgtgaccgccattggcgaggattacatcgagctgaaccagaacggcaggaagaaccgttatccggcaggaactgtaatctggacagcaggtattgaaagtgcggacatcaccggggaagctgcaaaaatcctggaatccgtgggacgcggaagaatccaggttgattcttaccttcgggccaaggatcatgaagaggtatatgtagtcggtgacaacatgatgtatgtgcctcagggagagaatgaacctgttccccagatggtggaaaactgtgagcagagcgctcataccgccgcccataacctggtctgcgccttgactggcacaggagccatggaggagtataaaccatccttccacggcgtcatggtctctgtaggcggccgttatggagttgcacgggtaggacttcccaatcacatgtttaacctgtgttccttctttgccatgctttccaagcattttatcaatgttgtttactttattcaggtattaggctggaataaggtatggagttatgtttgccacgagttctttaccatgagaaactgcagaagcttcttgggaggccatttctccaacagaaccccaagctttttgctggcgcctctgcgcgtatggctgggagccgtatgggtgtttgaaggcgctatgaagattgtggaaggctggatgggccagccaatgctgagcggattctttggaggcgccaatcagttctttaacagcatcctggctccttacggaatcacgggcatcggaggggcagcaccttcggctgatgcagtttccagcgcaacttcggctgcggctgacgcagtagccagtgccaccggagctgcggctgatgcagtttccagcggtgtaccggttttctcctatcatatattgggattgatagacgctacccttgtcagctccgtgggcttatcccatgccactctgtctgattatgcctttaaactggattttgctcccatgaactggtttgtgaacaacgtgatcctgcctaacggcggactgcagctgttcatgcagcgcggtatcgtgatcgcggagatcctgatcggccttgctttgatgggaggtttgttcaacttcctttcctctgcagcctctctggtgcttcagttcatgttcgtctgtactacaggcctttacttaaatacgttctggatgattttcgccggcatagcagtcttaatcggcggcggcagaacccttggccttgactactacgcaatgccgtggcttaagaaaaaatggagaaaacttccctttataaggaagtggtatttatacaatgactaatagagaattgttggaggatgccggcaaactgcggtatgagtttgaagaagcttttgaattgatggcattagctgtggaaaagcatttatcttcagcacctcctgtcatcaggaattatacggctcatctggctaaatccaccggcaaattcatccgtgcttacgggctgatggcctgctccatggatgaggaggataaagtcccggctgaagccgtctctctggcatctgcggtagaactgctgcacctggctacgttagttcatgatgatgtgattgatgacgctgatacaaggcggggaatcgaaacacttcaaaagagatttggaaaaaaagcggcagtcatctgcggagactatttattgtctctggcccttaagctggcggcttccatccctgagagaaatgaatataacgctttggatatgcccaattacctgtgcaggatctgcatgggcgagcttcgtcaggaaattaacaatgggaacctggatttatcggtttaccgctacttaagcatcatcaaaggaaagacagcagcactttttgaagcctcctttcacggaggcgccatgctgtccacaaaggatgtgagaaagcttcgcatgtaccggaaggccgggaacgatgtgggcatgatcttccagctcatggatgactgcattgattatgagatggaggaaacggaagcaaagaaaaatgtccgatctgattatgaagaaggagttgtcaccctccctctcatccatgccatgaaacaggatgaaaactttttaggacaggtgaaaaacggtctggtctcagccaaggaactttatgataaagttttagaagcaggcggaaccgcttatacaaagaccgtagccggcagatactatgcgaaagcttcaaacaccatcgggaatctggaattatccgaggcaaaaaaggccaggatcatgaccgtggtggataaatcttattatggtattaaaaaataatacaatataaagcaacataaggaggagtaatttctatgaaaaaacgagtattagctttaggctgcggcctcatggcagcagcatccattctggcagggtgttcttctaacttacagcaggcaccaaccactgctgcgcctacagaggctgcaacaactgccgcacctaccacacaggcggagaccaccacagaagctgcaaaaacagatgctgcaggcggcgccctgtccaccggttattcagtactttcttccatcggtaaatccacagatgccggcgaaaaagatggtcttgcagaagtagataccatgttcgcagccgtactggtagacgaaagcggaaagatcgtagattgtaagatcgattccgttcagacaaaggtgaacttctctaaagaaggaaagctgcttacagatcttggaaccgttgtagaatccaaaaatgagctgggagagaaatacggcatgaaaaaagcttccggcatcagcaaggaatggaacgagcaggctgaaggttttgcacagtatgtgatcggaaaaacagctgatgaagtaaagggaatcgcagtttcttccgaaggtgttgcagatgatgcagacttaaaggcaaccattaccgttcatatcggagactttatcactgttgttgagcaggctgtggcaaatgccaagagcgcaggtgctttagccggcgacaaactgggctatggcatcgttacaggtatcagcaagtccaaggatgctgccgcagatgctgaaggcgtagcacaggcttattctacctacacgatcgccagctttggcgcagacggaaagatcacaagctgccttcttgacgcttctcaggtcaatgtaaactttgacgctaccggtaagatcaccagcgacttaaagtctgctgatttcaagaccaagaatcagttaggtgaagcttatggtatgaagaaggcttccggaatcggtaaagagtggaacgaacaggcagccagcttcgcagaatatgcagttggcaagacagctgctgatatcactgggcttgcaattgatgaagcagaaggcgcaccaactgatgccgacttaaaagccagtgtaaccgttggtattggtgatttccaggcgggcatctccaaggctgaagcaaatgcaaagtaaaaaagcagtaaaatttattataattgccggaactctggcagcgcttactatggcggcggttaataccgccgccataggagcgaaaaaggagcaaagattccatgccgaatttttgaatctctttgataccgttacccagatcgtgggatatgcaaaaaataaagaggaattcacccaaatagctacggacgttcatgaccagctggaaacgtaccacaagctgtatgatatctataacgattacgaaggaattgccaatattaagaccatcaatgacaatgccggcaaaggccctgtgaaggtggaccagaagatcattgatatgctgaagcgggcagaagaagcctatgaaaaaacagatggaacggtgaatgttgccatgggaagtgtcctgtccatctggcacgactaccgtacctggggcatcgatgatccggaaaccgccaagatccctcctatggaagagctgaaagcggcggccctacatacggatttttcaaaagtcatcatagatgaagcagcctccaccgtatatctggaggatcctgatatgaggctggatgtgggggccatcgcaaaaggttacgccacggagcaggcggcggaattcctggagtcaaagggtgtcggccatgtccttctcagcgtaggaggcaatatccgcgccatagggaagcgggcagacgggaaaccatggaagctggacattcaaaacccggatactgacagtgaaaaaaccgccatcgataccttggccttagacggactttcccttgtcagcagcggtgattatgaaagattctatatggtagatggagtgaagtaccaccatatcattgatcctgctacattgatgcctgccgcatactttcgggcagtttccattgtgtgcagggattccggctggggagacgctctttccactgccgtatttaatatgccttatgaaagaggacttgccctggttgaaagcatggagggtgtggaagcaatgtgggtcatgccggatgaaagcatacggaccagcagcggatatgaggcataccgcagccatgacaactaggctggaggccaaaaatcgtgagtgagacagaggaaggaggccatatgtcatatagaggactgcaggattttattcataaattggaagagagagggagctgatccgggtaaccgagaaagtatcccctctcctggaaataacggagatcacagacagagtctgcaaggaggaaaattccggcaacaaggcgcttttgtttgaacatgtggagggttccccctatccggtgctgatgaatgcctttggcacagacagcagaatggctctttctcttggagcggacaagctggacgatatcgcggcagacattggagcctatctggactttagcaattattcatctattttaaagctggtctcctttgctcccaggctgctgcgcctgttgtgctgttttcctctccggagcaaatttcatttaaaacggccaagctgccagcaggtgatcgagagagacccggacttaagccagctgccggttttgcagtgctggcctcttgacggaggacgtttcttcacccttccccttgtctttacaaaatatcctgatacaaagctccagaacataggcatgtaccggatgcaggtactggattccaggacaactgccatgcactggcaaaagcataaggacggagccggcatttacgaagcttaccggaaaaagggctgtccaatgcccgtatcggttgctcttggaggcgatccggccgtcacctacgcttccactgctccccttcctcccaggttagatgagatgatgctggccggatttcttaagaaatggcctgtaaaaatggtaaaatgcatcaccaacgatctctatgtaccggaggatgcggaatttgtactggaagggtatgtggaccctcaggaagatctggtctgggaagggccattcggagaccataccggatattattccctggcagactggtatccgaaattccatgtcacaaccatcacccataaaaagcatccggtctatcccgccaccgtagttggaaaacctcccatggaagactgctacatggcaaaggctacggaacggatattccttcccattttaaaaatgacgatttcagagctgctggatatccacctgccctttgaaggagttttccataactgcgcggtggtatcagtaaagcattcctatccgggagccgccagaaccgttatgaacgccatctggggaatgggacagatgagatccgccaagatgatcgttgcggttgacgaaaccatagatccccaggatacggccgcagtctggcaggaagtcttacgctatgccgatccaaaggaagattttgtggtcagcaagggaccgttggatgccctggatcactcttccgattatcccttgtatggaggacggcttggcatagatgccaccagaaggggaaaggaagcattcacagaaggctcccttgaagtcgtgcctgtacgcaaggaacagccctgggacggcaggcgaaaagcccttgcaatgctggaggagaaaaacgcctccctcatcctggttgtggatgaggatgtagaccccgccgatcattccacggtcatgtggcgtgtattcaataacattgatgttgccagagatatgttcattgatggcaggcgggcagcttttgatgccacgagaaagcgtctggaagaagggcttacccgtccctggccggaggatattatgatgacggatgagattaaaaaaaaggtatcagagaaatggagtacttatgggatggatcattggaaaaatagtaaataaattaaatgaatacgggaagctggtcatgttcagccataccgtcttctccctggcctttgccgcagtgtccctccttgccgtgtccggcggacggcctgatccaaaggcagtgttctgggctgcccttgcctttttaagcgccagaacaggggccaacgcactaaaccgggtggtagatgccaggatcgatgcaaaaaaccccagaacagcaggccgccagattccccagggacagatcggaaaaaaggaaaccctggctctggtggctgtctgctttctggtgatggtgttcagcgcctcccgtttaaacctgctgtgcctcctcctgtcccctgtggccctgttcctgatgacgatctattcttacacgaaacgctttacctggatgtgccatctggttctgggtgtcacatgcgcctgcgctcctgtgggagcctggctggcggtaacgggaaaattttcccttattccccttttcttcggtgcggccaactgcctctggactgctggctttgatattatctacggctcccaggattatgaatttgacaaggcaaacggccttcactccattccggtgcagtttggcgtgaaaggcggattgctgatcagcactctgttccatggagctgcgctgcttagcctgtgtatcgccggggtgctgctttatccgcagtttggtgtcctttacggaacaggtttaggaattatcgtaatcctcatggtgatccagcaccggctggtatcaccggatcacttagaaaatgtcaatatcgcgtcatacagcatcagccagatcaccagtatcgtgcttctggttttcgggactctggatgtatatttataatgcaatgaaaagaggcggactatgaaacaatatgttgttggaattacaggcgcaagcggcagcatttacggtcttcggacaatagaagccctgcttgaggccggagccagggtacggctcatcctgacggaaaccggagaaaaggtcattgcttacgagaccggacgggagccaggagaatggatcgcagaatttaaggcgcgtttctcagacctgcttatactggaggataacaaggacctgttttctgcggccgccagcggttcccatctggcggatggaatggtcattgcgccctgctccatgtcaaagctggcccacattgcggccggcattaccccggacttacttacacgggccgctgatgtggcattaaagcagcgccggcctctggtggtgatgcccagagaaacgcccctgtcccagattcatttaaaaaacatgctgactctggcagagtgcggtgcattcatcgttcccgccatgcctgccttttatcagaaacccaaatgccttgatgacatggcggatttcatggccggtcgggtactggactgcttaggagtagaaaaccaccggtatgccagatggaaagaaaaatgttagaaacgaaatatgaaaacgaaatatgggaacaaaataaaataaatggaaaaccttaaaaggattgcaggaaaacatatgaataaaacaggaaaaaaagcgataaatcattccctcttgggaaacagaaaaatcctcactctgctgctgtgcggcgcagcagctgcccttcttggcggctgtaccggtaaggcaaaggctccggttgacaccaccgttcatttaggcgttatgtactcttccgacattgtgccccttaccatcatcacggaacagggacttgataaaaaatacggatttcagctggatatgcaggtattttcttctgcaaaagaccgggatgcagcacttcaggcagggaaattagacggggtatttacagattttatcggcctttgcatgtatcagaatgccgaactggacgtaaaggccaccggatgcacggacggggattatgtgctgctggccggaaaagatactgggatcacctccctggaagatgcatcaggaaaaagcattgcaatttcggaaaacacgctgatcgaatattctcttgactatattttaaataatgcagggttggatgacacgtacctggacaagcaggttgtgccgcggattcctgacaggcttgaaatgctgcgaaacggcaagatagacctggttcttctgcctgaaccattttccaccctggccatcaaggatggtgccgtggtcctgggaagcgccaacaccgatggactgtatccggccgtatctgcatttacaaagaaagccatcgacgagaagtccgataccctccaaaagatgtatcaggcatacgacgaggcggttgattatcttaacaacataccccttaaagaatatgaagccgttatcatcaagggtgccggctatcctgaagagcttaccggagctatcaagcttccggtataccggaaaaacgaattgccaaaagcaactgacttacaggctgctgtggagtgggcggcaaagaaagggctgtgcagccctgagttaaagcctgatcagctgatcggagaactgaaataaaaagataaagccagaggagggaaccagatgctggaaatgaaagacatttccgtcatatatgaaaaaggcgggatacataaggtaattgaccagatgtcctggaagctggagacaggaacagtcctggctgtagcgggtccctccggctgcggaaaatccaccatgatccactccctggccggaatcctgccctatgagggttccatcaccctggatggaaccggccttgatcccaaaacatgttcgattggactgatcccgcagaattacggtcttcttccctggaaaacagtaagggaaaactgccttttcactgcgaaaatcagaggaaacataagggacatggaaacacggctttccggcctgtgcaaggaactgggaattgacggactatcagaccggtaccctggcacattaagcggcggccaggcgcagcgtgtggccctggcaagggcctttctcatggatccgaagcttctcctgatggacgaacccttcgcagccctggatattggggcctctttggccgcaagagagctgtttctgcgcatctggaaggaaaaaaagcctacaacagtgatcgtcacccaccgggtagaggacgccctttatcttgctcataaaatcgcagttatggaacggggcggcggcttcaatttcttcggcaccaatccatggcaaggcataattcgtccttcagaagcagcctatggggaactagcacagcatatcacggagaaaatcataaaggcggatgagatatgagaaagaaaatgtgggtctttttaaagggatttttacttgtaaatctgctctggttctttcttgcagcctttctgtccacttcggtgctgcccggccctctcacggtttacggcagatttgaccaggtgatgagcggaaagctctggcttcatgtgggggccagcttaggccgtgtgggagcgggtttgtccattgcccttctcaccggcattcctttaggccttgtcatggcatcttccaccattgccaaccgcctccttcatcctttggtttacttttcctatccgattccaaagacagctctgctgcctgtctgtatgctgcttttaggccttggtaacggctctaagatcctcatcatcgttctgaccacagtattccaggtcattgtagctgtccgggatgccgcagaccatattgatcagggaatttattatgtggcaaaaagcgccggcgccaataagagaagcatcttaaaagatatcaccctgcctgcggtacttccggagctgttcaccagcatccggatcgggacaggaacctctttagccattcttttaattgtagaagcctacggaacccggtggggaatgggttactacatcctggatgcgtggtccagaattaactatattcagatgtacggcggcatagttgtcatgtcagtggttggatcagcattattctggatattggacgggcttcagtggaccttgtgcaaaagcacaaggtaactggcgtctgattctcacatatcaatagctaacgcagccggcttttacagccggcttttttcatgaagattatgcatatgttgtgtattttacacctttgtgtgatattgtcggatttacattcccagcccccacagctaaaataatattatcagattaatcagtgaaacacccatagggaggagagaatcacatgaagaaaacagcactattatcagcagtcatattagccatgacactgacagccaccgcctgcagctccgggaaacaggcagatacaaaagcaccggctgacaccggaaaaaccgaagccgccgctcagacaccagaagaggaagaaccggttttagtagtctataccgcccgcggcgaatcattaaacaatgccgtgattccggaatttgaaaaggataccggcataaaagtcgaggtggtagtagccggcaccggagagcttttaaagagagctcagtcagaaaaggccaatcctcttggggatatcttctgggttgctgaccagaccatgttatccgcttccaaagacttattcatggaatatgtatcatccgaagacagcaacatgatcgatgcattcaaaaataccaccggttactttacccctgcatttgcagatcctacggttatgatcgtaaacaaagacttaaagggcgacatgaagatcgagggattcgaagatttattaaatccggaattaaaaggaaaaattgcctttggcgatcctgtaaactccagttccgcattccagtcattgctggctatactttacggcatgggcaaagacggcgatcccctttcagacgaagcgtgggcttatgtagacaagttcatcaccaacttagacggaaagatgagcaacagctccagccaggtatataaaggcgttgctgagggcgaatatgtggttggcttaacctgggaagatcctgctgccaactatgtcaaggaaggtgccgcagtagaagttgtattcccggttgaaggagccatattccccggtgagtctgtacagattttaaaagactgcaaacatccggaaaatgcaaagaaatttgtagattacatgctgtctgaaaagatccagaatgcagtcggttccacacttaccgtacggccgctgagaaaagatgccactctggctgactatatgaaacctcaaaacgaaataaaattatttgataattacgatgagggctgggtggcagaacacaaattagaaatcaccaatcggttcagcgagcacttggaaacatccatggattaataaactgcatcaatctaaataaaagactgcctgagactcagtcaggggcagtctttttgtacaaaaaaatatggagtatgttaggagatatgaactatgggagttgcgatcagtatagaaaatacagtaaaacgttttggaaaagataccattatcaatggattatcactggatattaaaccaggggagttcttcaccctgctgggaccatccggctgcggcaagacaaccctgcttcgtatgatcatcggctttaacagcatcgagggcggtgaaatcaaggtagacgaaaaagtaatcaataacatccccaccaacaaacgaaacatgggtatggtattccagaactatgccatttttcctcacatgacagtcagggataatgtggcttttggactgaaaaacagaaaaatgcctgcatcacaaatcgaggcccaagtggatgaaatcttaaagatcgtaaaaatcgaccatttaaaaaaccgtatgccagccaaactgtcaggcggtcagcagcagcgtgtcgccctcgcacgtgcaatcgtcatccatcccgaagttctcctcatggatgagccgctgtcaaacctggatgcaaagcttcgtgtggaaatgagaaatgccattaaacgcattcagcagcagatcggcatcaccacggtttatgtaactcatgaccaggaggaggctcttgccgtatcggaccgcattgctgtcatgaacggcggtgtcatccaacagatcgatacgcctaagaacatctatcagcgtcccgcaaacttatttgtatccacctttatcggcttatccaatatcctgtccggtaaaatatcgaaaaaaaacggccatacctccattcaaattcaggattatgccgtgcccatggatcagttaagccaggatgtaaaagacggacagaatatcaaggtatccatccgccccgaagaattcatcatcaaccaggcagacggcgccggcattcctgcaacagtaaaaagcagtgtatttctcggcattaccacccattattttgttgtcctggctgacggtcaggaaatcgaagtcattcagaattctgatatctgggatatcattccggaaggttctcagatccgccttgctgtgcagcctcaaaagatcaacatttatacggaagacggaaatagaaatcttgtgataaggagggaccagttatgagatatgcaggcgaaaaaaagttcaatatctggattgctatggcactggggattctctgcctttttctcatcttcgtagtttaccccttgattctcatattatataagagtgtgctttccgaagatggctccttcagtcttgcatatttcggtaaattctttgccagaaaatattaccggagcacactggtaaacagttttaaggtcaccattgtttccaccctgctggcggctgctctaggtctggtcatggcatatatcctgcgaagtgtgcggatcaaaggaagtaagtttttaaatatcctgatcgtcatgtcctatctttctccgccgtttatcggagcttatgcctggatccagttattgggacgcaatggctttatcaccaggatcttaaacgacctgtttcaggtgaagttaaacggtatttatggatttacaggaattgttctggttttttctcttcaatcctttccactggtttatatgtatatctccggtgctcttaaaaacctggataactccttaaatgaagccgccgaaagccttggctgcagtgccgttcagagagtgctgcaagtgatcgtgccgctggtcatgcccaccttgcttgccagctcccttctggtatttatgagagtgttctcggactttggtacccctatgctgatcggtgaaggttataagacatttccggttctgatgtacagccagtttatgggcgaagtcagtacggatgaccattttgctgctgcactctgtgtgattatcatcggcatcacactggtgttattcttcttccagcgctatcttggaaaccgttatacctattccatgacagcattaaagcccatggaagcagaacattgctctggtcttaaaaatatattatcccacctgtttgtatacctggttgtcctcatcgccacccttccccagcttaccgttatttttacctccttcctggctaccggaggcggaagcgtgtataccggcggattctctcttgataactaccggaacacactgttttccaagaataacaacggcgctattttcaacacttatttattcgggctgtgtgccattgctgtcgttgtggtcctgggaattttgatctcgtacttaactgtacggaaaaaatcatttttaactaatatccttgatacggtcaccatgttcccatacattataccaggctctgtactgggtatctcatttttatatgcatttaacacaaaaccgtttctcctcagcggtactgccctcattatcgtcatctcactgtccatccggcgtatgccctacaccatccgttccagtactgccattatcggccagatcagccccagtgtggaggaagccgccatcagtctgggctgttcagagacgaaatcttttataaaaatcacagttccaatgatgatgtccggtgtattatccggtgccatcatgagctggatcaccttaatcagtgagctgagttcctctatcatcctctataccagcaagacccagacactgaccgtagccatttacgcagaggtcatcagaagcaacttcggaaatgcagctgcttactccaccatcttaaccctgaccagcatcctatcgcttcttttattcttcaaaataacaggcagcaatgacatcagcatatagcgtaagcaatgagcagtgggaaataagtcatgaaaggattttcgttgtgcttgcacataagaaaatcctttcatgacttatttcatagggcgaatgcccgttagctcataaaaccgcaggttttatgagctacactgcggacttatgttataatagacacaagcacctatcccccccatacaacgataccattggaggcctcctcaatgaaaagtaaccaatacaaagactacattaaaaaatcctttatcaaatacgccctttccatcatatcactgctgtttgtgctggtgcttttattcctattagtcaatgtacattggctgatctccggctttaacaaaaaaaatcattcccagttatccggtatcttagatcagcagttcctgctctaccagcaaggccttaccaatctttcccaagatccggatctattaaccgcactggacagcacagaccctgccgccatcactgcaaataaccggctactttatgacttttccaatgcccagacaatccgttcatcctttgtgctcctaaaccagagcggacgcatcaccagcagcaatctgtttgccggaaatcaggaaatattccttgacagtgatatctttcgccgcatgaccagtcagatgcaggaacagcctgaaaagatcttcgccctgccaagcagattaaactatgcccatgggcaggcaggagatctgatccttggcaaagcagtaataaaagagggcaaacttaccggctatctgttttttgatttgctggattcttatctttacgagatcatccgcaaatatcccctggatgatgttatcatcacggaccggtatgataacctcatcttttccatcagccgccagcagaccgaccccatggacaaatacccttccggaaaataccggatggactggcaggaaggaaatgtggtaaaagtaaatggaaaacattatcacattcaaaaaagttcacttcccgggagctcactgatcttatattcacttgtctccactgaataccagaagaatcttttatattacggttttatattcatgcttaccgtaggaatccttctggtgatcatttcgctgcctgtaaccgaacacattacccagaaaaacctgctggccatcaatgagcttcagaaatccattgaacagatgggaaagggcaacatggactatcagctccgtactcaggtctttgatgaattccagaagctggatgatgcataccgccatatggtaatgcagcgggaagaattgctgacttataacaatgagctgtccgaacgaaagcggatcatggaaatcaaacaattagaagaacaatttaaccctcactttattttcaatgttatggagaccctccgttatgagattatgatagatgctgcaaaagcttctgatatggttcagtctttcgccagcctcatgcgctacagcatccattatggcagtaccattgtctcactcagaaccgatattgaatatatcaatgattatctcctgttacagaaaatgcgctataaccggcgtttgaaatatcatattgacattcctgaagaacttctggaataccggattcccaagctgctgctccagccggttgtggagaattcccttgttcacggcatgaaaaatacccactccatctccattacgatcacaggacgtgtgcatggtgatctgctggagctgtgtgtggaggacgacggaagcggcatagatggggaacgccttgccagtctgcgggccgggctggagtctgaagacgaatataaggagcatatcggtctttataattcccatcgtgttgtccggctgttatatggccctggatacggcctgacaatcgaaagccagccaggttccggcacacgggtcactgtaaccatgccggcagatatggaggattattatgtataaggttttacttgtagaagatgaagatatcatcagaaaaggcttgatgttcatggtaaattggcaggagcttaactgcgtggtcgttggcgaagccatagacggagttgatggcattcaaaagatcaaagacaatgaacctgacattgtcattgtagatattaacatgcccgtaatgaacggcctgcagatgctggaagaaagcattaaagaacacggctatgaagccattatcgtgtccggatacggggaatttgaatttgccaaaaaagcgatccgccttggcgtcactgaatatcttttaaaacccgtggatttcacagaactatatgatgcaattcataaaataaccgaaaagctggaagcaaacacacggatgaagggatacatccggcaaatcgatatggaaaagaaaaagctgggcattttagaaacagatatttcagaaaccgtcaccttcaaaaacaaacatgtgagtgccatggtaaagttcattaaagagcattactcttcccgcctttccttgaccgatttaagcgaagaatataatctttcctgtacctacttaaatacgaaattcaaaagcgagaccggctataccttcaacgactttttgaaccgctaccggatgcagaaggctgtggaacttctgaaatcagatcagtataaagtttatgaaatcgcagaaatggtgggattttccgaatataagtattttattaaggtgttcaagaagtatattggctgctctccggcaaaatttatggaggcaggggatgggaagcagatattataacccccggcctgcagggaaaaaacaggcaacttaatgagaaataacaggatagaagtgagaataaaagaagacgctgatccactaaaaatgaatcagcgccttcttttattgtgtccttgacaaaggtattgtttatccctttcaacccacttaccgcttcagaacccttacagaaagctgatatcactgtttccctttaaggtgaactgatttgccagactgctgagcattcttgcctgtgcggacagttcttcacttgcagcggcactttcctgggcggtggccgaattggactgcaccactgaagtgatcttttccacgctgtcggtaatgtgggaaacagaaaggctctgctcctgtgaggctgaccggatcttcccgatgccggaagcgatctctctggcatccattaaaacggtattgagtatccgggccatggaatcgcttaaatcctttcctgtctcaacagacctgacagaaacatcgatcagttcagaagtattttttgcagcaagtgcactctttgctgccaggttccggacctcatctgccactacggcgaaaccctttccagcttcacctgccctggccgcttcaacagccgcatttaatgccaggatattggtctgaaatgcgatatcctcaatggttttgttgatctttataatttcctctgaattcctttggatgtcatccattgcctgaagcaaaagccgcatctgctgctcactctcatcaaggcttaccccattgtctgcgctttggtgttaaaaataccggcgtttgacttcgtataatctatttttgttacaatggtctctaccgcatgagacaggtcatcaattgcgctgttctgctccgcagcccccacagccagcagctgggagcttgccgcaacatgctccgcgcctgcggatacctgttcagaggtctggtgcagctggccaagcgtctctgatatctgcgcagaaaaattctcaatggaatgtccgatattgataaaatctccgatatactgctgggagggtaagtcaaaattcccctgttccatctgcttcatggaatctccgatacgggaaatgtaatcggaaagggtgttaatggacacccgcatgctgtttgccagcattcccagctcattactggaagaataatcgatctcgctctgcaaatctccctgagaaaggcgttccattccgctttccagggttttcaccggaatcaggatctttctgcggatgatcatcagaataaaggcgatggagatcaaattaattcctaaggtaaaaagactcacaattttaagcattgtgattccctgagcggagtacttctcagcctgggatacagcgtcgttgcttttgttaaaaagctcttcactgttttccagcagcttgtcattttgtttgtcgtttaaaaggggcaggatctgatctttccaatatgtacggatctgctgcatctgttcaaccagttctttgtcccttggaacgggaagacccagttccttgtcgcctgcaatgattccatccatggccttctctgccttcgcgatctgctcttccaccggctgctcaagcaagtggagcttcataatacgctgtgttgcacctcttacgacaccgcaatagttcacgatctttccgttgctctggttctggtttaaaagccaaaacatcaaaccggcatttaacacgcttagaagagcaaggcaggccattgtgctgtaaataattttcttaatactcacgttttgatctcctttaggaatttgtggtgggattactcttcagtcaataacacggcatattttaagtggctgcggcaaaaaatatgtcgtatattgtcaatatatggtgatatcttacttcaaaatcaagagctagtcaataaagccttatgaccatttccggaatttattgaaactttttttcttcagcttcacaccgcactgcttcatgataaacattctcacatccgcagcaagataatttctctcatctgctgccgtttctgtaataaaacagaccagggaaaatcctcccatggtctgtcttcctaaaaaatataaacgtttttattccctacgatgcctgggctccatggagacgggcaaaaattcctccttttgcaatcagctcatcatgagtacccatctccgctatacctgtcccctcaagcactacaatcaaatcggcctcacgggtcgtagaaagcctgtgcgcaatcattatggtggtgcgctcctttgatatctcattcaaagccgcctgtatttccttttctgttttcgtatccagagcagaagttgcctcatccaggatcaggattggagaatctcttaaaattgcgcgggcaatggcaattctctgcctttgtcccccggacagcaaaacaccacgttctcctatatacgtatcatatccgttttccatcttttcaatgaaatcatgggcatttgctgcctttgctgctgcgatgacatcttctcttttggcatccttccagccatattcaatattttcatacacggttccattaaaaaggaatgtgtcctgcagcaccatggagatattatcccgtaaactggatagggtcacatcccggatatcaaccccatcgataataacagccccttcctgtgggtcataaaaccggttgatcaggtttgctatggtgctttttcccacaccggttgtccccaccaaagccactgtctgccccttcttaatggtcaggttcatacgtttcatcaccggaatatcttcctgataaaaaaaagaaagatctttcagcacgatttcaccttcaacccttttaaggacttttgcatttttcttttcctttacctccgggatttcatcaaaaacatcaaaaacccgtctgcatccggctcctgcttctcccgccctttctgcaaggccggaaaaactttttacaggaccataaaacatggacagatacatgacaaatccaacaatgtctgcaatttccacttctcctgttcccactaagtacccgccataaacgaccacaatcaccgttcccagagcagtgacaaaggcaagcaaaggataggttgtctcaaaaaagaagcttgcacggagatacgccagactgtggcggagagaaagctttgcaaccgtttgttcctcatggctctgctgattaaaaatctgaatttctttaatgccggaaagattgtcctgcacctttcctgcaagctcccctcttaccctggaattttctttccatgtgggagatacatggcggctctgccacaaggtaatccccagcaaaaacggtatggtaaccagactcatcatggcaagcttcccattgatcgtaaacagcaaaacacctactcctgtaaatgtaagaacattgactgcaaaatccggaatcacatgtgccaaaagtacctcagcatccagcgcatcatttactacacggctggtgagatcacctgtcctgctcttgtgaaaatagcttaagctcatatgctgcagtttcccgtatagccgtttacgtaaatcggccacataatgaagagccgcataatgatttagatacccggctgcagaagttcctgccgcctgaattgtagctgcgcacagaagcaataacccgatacgcagggcctgtacctgaaaatcactgattccttctgtagcaagtgcggttaattcccttaacgcccacggcgtataaaatccggctgccgtagataccacaagggcaaaaagtgcaagtatcagatgaatccggtacatttttgcctcccgaaatatccgcagtgctgttctcatacagaaatcgcctcctttgggtacaaatgttcctgatgtaaaagagcgtaggtcaggcacacaggccgcccggttcttggttccctgacaatttcagcatcaatggaaaatgtctcctttaaaacaccaggcaccattacttcttccggactgccgtgctgaataacttttccgccgcggaccgcaatcatataatcagaaaaacgggccgccagatttaaatcatgaagaaccatggcaatggtacagccctggctgcggttcagtccatgcaaaagctccagcacttccagctgatgagccagatccagataagtggtgggttcgtcaagcaaaatcagatctgtctgctgggcaagcgccatggcaatccagactctttgacgctgtcctcctgacaaggtatttacttccctatgctctaaatccataagcttggttgctgagattgcccacctcacaatttttttatcctcaggggtcagttttccaaacccgttttggtggggaaaccgtccatatgcaaccagttcacttactgtcagcccgctgggagcggaaggagattggggcaaaatcgccattttttttgcaatttctttggtgggaagtgttgagatatcgcctccatttaaataaaccattccgtttttcggcttcagaatacgccccaccgctttcagcactgtggattttccgcatccgttagggccaataatggaagtgatttttttatgaggaattaccatatctaaattctccacaatcagagcgttgtcataggcaatgtctaattcttttgtcgcgatactgttcataccgtcctccttaatttgctttcgccaatagatataaaaagtacggtgtgctaagcgccgtaattacgatgcccgtaggcacatccgccccaaggctgatggttcttgttatggtatctgcaagcagtacaataattgcaccgcaaagcccggaggcaggaaggaacaatttatggtttggccccattaattttcttgccatgtgaggagaaatcattcctacgaaaaagaagttcccacccagggatacgcttcccgaagaaagtgctactgctgctacggtcaagccgataaattccggtttcacagctaccccaagaccagaagctgtttcatttccaaggttaagaatgtttaaaatatgggctttagaaaatacataaccgcataaaatcaatgtccatggaatcagtatggcaagatacctccattcatctccccataagctgccggcgctccagcgctgtataaagtccatctgattctgatccagcttaagagtcagcagtgtggttaaggccccatacccgcttcccagcgcaacgcctgttaaaatcagccctgtaggagagatatctctctcccttctgtaggaaagcagaaaaatcaagcctgcggcagtcattcctccaaaaaaagaaagcaatggcattaaaattgcagatgacaccgtctttgcggaaaacaataccacaaaaatcagtacaaacagccctgaaccagagctgattcctaaggtaccgggacttgccatatcatttcgcagaaggctctgcataatacagccggaaatgcccattcccactcccacaagaattgacagaataatgcggggaaggcggaattctaaaacaattaaattttgctgcggggtgccttttcctatgatcacatgaaaaacttctccgggagtgagattcatttttccggagttcatgctgatcactgccactgctgccattaagatcaacatcatcagaaaaagaaatcttccccgttctgccggataaccatgttttttcattcaaattccctcctttgctttcttgcaagataaaggaaataaggaacaccgatcacagcaaatatgataccaatgggcgtttcataaggtttattgatcagccgtcctattaaatcggcaaaaaccgtaagcaaggccccgtaaagccctgaggccggaatgatataccggtaatccactcctaccatatatcggacaatatgaggcgtgataagcccaacaaaaccaaccggccccacgataatgactgaaagcccggtaagaaccagcacaatcagtgaagaaacccctttgaccaatctggtctttaaccccagtccggttgcaacgtcctctcctaaactcagcacagtgacagaaggggaaagccagaacgctgcaagcactcctgctgcaaaaagaggcaggatgatcatgagctcactccatttagcacccgcagttcctcctgctgtccaataagcaagggcatgacccagatggtatttaatggacagaaactggctgaaagccccaaacagcatggaaatagaaatccctgccaatacaagccgctgaggcgtcatccctccttttccaagggaagcaataaaataagtcattgccgttgcagccgcagcccctgtacatgaaaacaaaatggtctggccataggtgcgtcccggcagaaatgccatacaaaacgccatggcaaaggtagctccggagctgatccccataaggccggagtcagcaaggggattccttgttgttccctgcatgatggccccgcaaattgccagactgcagcccaccattaaatctgccacagtacggggaaggcggagtgtctgaatgatctgatgctccgtcatatttggatcaaaccggaaaaccgcttcccaggcagtaacaaggcgcatgtcggcagcaccaaaagaaatggatgcagccgacatgaaaagcaaaagcccaaaaccaagaatcatataaatagcaaagccggcggagcccttccaccgccgctttattgatgtaattttcattatagcctgttcctttccgtggaaactttcaagttactcaggcatatttagcatcccagccaaaagataatccaactgtgcagttaagctggctacatcagaatagtaaaacagtccctgatactttcccggaatctctgcgatccgcccgtctgcaacagcaggaatgctgttccaaatatctgtttttgcatattcggaatctttaccttcctgctggaaccataatatataatctccgaaatattcatgagcaacctcatagcttagggtccctctgctgttaccggattctttaatcagtttctccagcttctccggttttttaagctcaagatagttgtaaaccaaagttccgcctctggaaccagtctcataggcaacaccgttccaatcccccgatggcccccagtcttccagaatgctgaatgttttcccctggtatttatcgctttgcagctcttcctttgctgcggcaagcttttcctcaaaggattcggtcaagacttctgcttcttttgtttttcctgcagcctctccaattatgctcagacgctcaacagagcttacgctttcctccggaatgacaagtaccggagcaatttttccaaacttttcaaaatcctctgcctgataagtaataatcagatccggttcagccgccatgatatcttctgcagcccagttctccagcttggcatcagaagaaaacttatcataaaacggcatggtttcctgctcccaggcattgtatcccaccacattcaaatctaaggaaagcacatctcctatgtaccaattcacaactacccgctggggctctttcggcacttgtatttctcccataactgtattgattgtgtgcatgtccggcacttcagaaccttcccggcttgcattgctgcatccggtcaacgtaaataaaagcgcaaacatgaaacaacatatggatcctattttcttcatatcaattctcctcaaaattgtgataatgttccccttttcagcataagagcttactttcttttgctttatgttagttttaactaactaagcagaatactagcataataaaaaatatacgtcaatatggcctgtgcccattgccaggaagttacctttttcatttaaccgctcaaacatgctgttttcggccgatttttaacgtatttcgtttttacggtcagcaatatggagtataaataaatcaaattggagcactgtctcattgtattcttttttgctttcatgtataattgggagaatagaaatcagaaagtgagcccttattcaatgaatgaatatcaagccgcctcatggggagccatgggagaaaaatataacctggatcagcggacctacggaccgggaatgggatattactttccgcctcactggtccaatggctggattgttgaagcatgtcctgcagaaggcctgtttgtttccagtgcatggtttactccggataaaaaggttgttcacaccttagatgtgaaaaaaccatgtatgtggatcttttgtattgactgcggcagtatgatatattcccggcaaggcaaagcatcaaccacgtttacgcccatgacccatgttctggttaatccccagagtccatttcatttgacctttccaaaaggaatccacaactgctttaccagcgttttaatttttgatgattttttacagctctttttacaaacaagaaacaatcctccgaaaatcagcattgcagatgcaaaagcatgggaatcggaacattacaactcaccaaataccatgatggtattagaacaaatccgctgggcagtgcgcaatgcggatatgcccctccttgcatttgaaggaatggtgcttcatctgctatgttcaatcgccagaaactatcctgtaactccagatcggaggagcagccgcagaaattatgtgacgtgggaaaatgagaaaaaggtttactcagtaaaattgaaaattgacgaaaacattctccaggttccgccaatggaagaattgacaaaaatagcagacatgagtgagagcaaattacgcctcagctttaaaaacatttatcagattcccctttatgattatatccgcagggaaaaaatgaaacgtgccatgcagcttttatctgcagaccatttgagtatccggtatatttcggagttgtgcggctataaaaatgcatctaaatttgctgctgcctttcaggatgttcatgggattacacccagcgagtttaggaagacttttaatttataggaggcggcccaatgaccattggaatgatacctgctattaaaaacagctcttaatacaagaatgggacgggggtgtttgacccctgctccatttttgcattaagagctgctttaattgttgattctattatatatctaactattttccccggtttattttatctgaaacccatcccaggatttgcttatgagttttcggactgcttctccactaatttcagcaatcgtcttatctccagcctcagaaatatcatcagcttctatccagaagagggaggcctgccgcttttccagatctccataaaaggtatctgcaatcacattgtactggtcttccgtaatagaatggccgtcagcatcctcagaagtgatcaccggcttgtcactcccatccgaaaaaatcatgctctgagaagcaagatattgctgtttcatggatccattctccagccagacagcccgcttgttgtaataatacgcagctcctccggctcgtactacatcatcgaaaataaaatagtaacggcttgccgccgcatcatagtagacaggcactgattctgtgataatatctgcctccgagtcgccctcggatatattattttcaaccggtaacaatccatccatggactcatttacctcccagatagaactgcgtgtataaaggccgcttccctggcaggtggatgcaataatttccaatcggccattctgattaaaatccgtaacggaataaccatagcggccataaagaatatcatcatctccccaccagagcgcaacgttttcagaaataagatccagctgcttttcaatgggttcggaatgattttcagaagctgtttccaaagcttgattttcctgctcctgttttagatcgttatcatctgttttctcgcttctggtatcattctgacctgaagatgattcctccggtgccactgtttccccggcagttgcttgggaatccgccgagattccccctttaccggaacaagcagtcaaggctgccatcattcctaccacacacatcagaacggcgatccgccggttccatagccgtttttttctttttttcatcctatatgatcgtcctttcgttaattacagccaattctggcactgccgattcctaatgcctccaagatttccttgtgcggccggtccgcatctgcatgaaatacatcaatatgattcagatccccgcttctgtcagtaaatgctgggaataagaatccacactccggtttccccggctcatactccctgctaacgggcagatggcacaaatcatatattcaaacacttcttccgattcccacaatctctccttatctgatgcctttgccggaatatcatatcgatcatggaaaagtaaaatggcatactccaaatccgtatggtagttttccataacaatgtcataaaacgtatccatcagagcatcattttttaatccgcattcattcatcgccataagcagctgccacatgctccccggttttcgcacgctttgtggaaattcatatttctttaagtttacattcgtggcagaaaaggggatctcctttgccagcttcagttttttggttctctcagatggggataattttaagaaatttgtattaaagctcccgtcaaactctccatccttatctacatagcatcctgcaattcttgtaaaggaggtccgggcaagggtcatccgccttgtcagctccagcatatcttctctgtttatcattgtctgtctattccttttctgtcattttatccaatttttcctttgcttcttttgcaaccaggattattcaatacctttacattcaactaagtgattatattttttgtgaaaataccattaattgcatatatttaggtgatgattccgtgccgtaataatcagagaacgttgcttccattttcatatttcgagtctcaagaatatttttcagctcttcaatcgaataaagccgagtcggttcgctatttcctaattccggcttatgtattacctggccataaggtaattgatatccgttaaagcgcattttgcgtgtttcttgatcccatgtaaattctgataatgacaattctttttcccccgctgcccaggctcttttgggaaagtattgttctgcgtgttctgcattacatacatccataaaatgcttgccgccacgctttaatgcgtgacctatcacatcaaatattttgagattctcctcatcggtattcaaatatccaattgcgccgtctgccaaattcaacaccacatcaaattcctcggaaaagtgaacatccctgatatcagacaggataaattccgccgacagaccagatgcggcggcatgtatttttgcgtcttttatataagcatcagtaaaatctacaccaacaacagaaaatccccttttggcaaaagacagcgcatgcctgccataaccgcatgccaaatctaaaatccgctcttttccggttaaactcatggttcggataagaaaatccacctgattctccgtatcttcaacccacgccatgtttttaatatctagcgtccagccagtattcataattgttttcctcccatataattcaatgattgaactataacatgagaaaaataaaaagagtagacttataattttgtttgtgatattatattgcataaggtgcgtcctcagggatgcacttttttatttgatcacaatggaacttattaaatcacgaaatcatgaccaccaatttgccgggtggccatgattcactggaaatgtggtttaccatttatatcgttttgcgaagatgtgagacaggatactgcgaattactagaagttcatagtattccctgtcttgcatttatctgaaataatccccttgttctgaaacaaattccatggttttttgcagatcagactccttcatcttctgaatggcaagtacaatatataacacggaaagtccaaaattaatgatcccgaacattggtatggaaaacggcagaaaggacataattgccttaatcaataaaggcagcgttctggcatagacccccatttgatacaactgtccaaaggtcagacggtatttcatgcaggaggcaactatcatcccaataagggcaacgaccagtactccaaagaaaaacaacgccgtcatgaatataaatgccagaaccataaaagctgttacaatcagataagcattcggtacccattgctgaagcgtctccctgctgaaatccatgtcaaattcggaaaagtatcttcccataatttcacctttattctttacaataaccttttccgaatccatcaggactacctgataataatctgaaatatattccccgatctcatccacatcataaaaagaggtatccggagccgtatctatataaatatatgtaccgtctgtttcgtattcgataggcttctcaacccaaagagtgccgtccttcaactcaaaatcaggaatataatcatctatgatttttacaaatccgcctgttttaaactgaaatcttataaagggaacaatcatggtcagggaaaaatatatgaccataagaacaactcctgcaaaaaaaaccttgctgcgtttattttttataaattccttaaagcttttaaaatcgtaaagagataatataagttccttaaatatgttcatttttatctttccttccttataactgtgctaatgcaaatccaattccaaagaccaaaacataagtcaaaatcagcaccacaatatccagggccactcttgcggctatatggatttttttgttggaagaaatagaaacagtagcagaacagccgattataccgatcaatgctcccaaaagaccatttataagatttatcgagtgcaatgccataaaaatatatgcccatttagggatattaacaggaacatatgcttcaccggttgcacagtctttcccgtcaatgaccagcttagttcccccaatcagggaacttacaatcaacgaagcctttttagtgccaacatctatggcataagcagtctgaaaccactctcgcttaacaaggaagtccttcagctttttttcttcattattcacaagaaccttactccccttcagcttgatctcataattcttttcatcaacctttactttccatactttactcatactcatgtatcctttctcttaagtgtttttatacatgattatcttatcatgtgatgaatgaaaggaaaagactttccttaatgtgctggtttaaatcctgaaccggtgcaactaattccgccgttttctgggtaaatacctcatcatgctttcataacttcagattttttaaaatagcgccggtaataactaccggcgcccagactgtaggcaaaagcaaaaagattatgtttctgattgaatactgattaataataattcattgtgttatctgtacttcaattcgaatttacctgtgtgaagtacgataaatcgacaattataagatatcttgctgtaaaaaagacatagcttccccttaaaaggaaaaccatgtctttttttatgttcccgagcggatttgaaccgctggccttccgcttaggaggcggacgctctatcctgctgagctacggaaacgcctatatgaaacggtaaagagacggcagaatcgctgttctcctctgcattcctttacggtccgtctactattatattcataatccgacgtttcgtcaagacaattttgtacttattccacctgctccgcaaaattcacggttccctgcatccatatctgtcccttgaatctgcgtccgatttcaggagttccagtcagatcctttttggcaattgccacatggaaagtaaggtcactgcattccaaggtgaaatcgtaaacctcttcatcggtgatctggttcttcttttcttctatcttaatgatctctccgataatggagtactggtcacattccacaccgcagggcataaagcaggaatcaatgatagagtataaatcctccttcatcacccttctggaagcctgggaatataaatcaatatcctcaatggtaagggtctccatggcgtcttcatcgccgttctttgccgcttccaaaagcgtattacggtcctttgccgccactctggccttttctctctgtgtttctgtcttctgaatgggaagcagaacctttccgcttaccgcaagcccggtaaggcagacgtccttagtatccatagggtgatgatcaatgatccgttccctgcactcaaaggaattgtctatatagaatatgagtgaaatccctaccttatattcatccataaggccggcgtaagtctctcgttccgtatggcgctggatggaacaggctacgtctgatgtcatatcattgcttttcaaatacggataatagtaacttctttgaaagtttccttcccggtccatctctccaaagatagcaatccccatacctggagccacttccctgcgaagctcgcaaagattggattcctcgtcaatctgaatccgtttcaagcctgacaaatcttcacagagcttatccaataacttatctatttccttgtctttctgatataggctgaaaccaatggttcttaagaatttatgcataggatcatcacctgctttctaataatataaaagaagttcgattcgccctggctcatcgaacggctgatttactaaactcaagctgcgctatgcctgccttcattaagtaaataataccgagaaaacaataaggcgaagattactccgcctcaagccttatcgtttattatataccataaatcatgataatgccagcacaattttcttattttaaaaattggggcccgttccctcttaatgggcacagacccctgattttcttatacgattccctgtgccgtcatggcttcaacaaccttttcaaagccggcgatgtttgcacccgtcacataattaccttttacgccgtaacgctctgcagctgaagctgcctttgcgtaaatgtccaccatgattctgtgaagcctttcatctacctcatcaaaggtccaggaaagcctctggctgttctggctcatctccagggcagaagttgcaactccgcctgcgttagctgccttgcccggcatgaagagcattccgctttccaggaagaaatccgttgcttctctggtagacggcatgttagcgccctcagcaaccgcaaaacatccgtttgctctcagcatttttgcatcatcaaggtttaattcattctgtgttgcgcatggaagagcgatgtcacatggaatactccagatgcccgttccttctgtataaacagccgttggaagcgcattggcatattccctgatgcgtccccggcgtacttccttaatttccttaaccaggttaagatcaatgccgtctttgtcatagatataaccgttggaatcacttaatgcgataaccttaccgcctaattggtgcaccttctctgtagcatagatggctacgtttccggaaccggaaatgaccacattcttaccagccagctccttgccgttatgctttaacatctcatcaagaatatatacaagaccatatccggtagcctgggtgcgtgccagagaaccgccataggttaagcccttgcccgtaagaactccttcatataagcctgtcagcctcttatactgaccgtataaaaatccgatttcccttgctcccacaccgatatcaccggcaggaacatcctgatctgcaccaatgtatctggacagctcagtcataaagctctggcagaaagccataacctctctgtctgattttcctttgggatcaaagttggaaccacctttaccgccgccgataggaagacctgtcagagaatttttgaatacctgctcaaagcccaggaattttaagattccctggtttacagaaggatgaaggcgcagacctcccttatacggtccgatggcgctgttaaactggacacggtatgctttgttcacctgtacctgcccattgtcatccacccacggcacgcggaaggaaatgattctttccggctccacaagacgctctaaaagacccatcttgcggtatttctcttcattggcatcaatgacaagccttaaagaatcaagaacctcttttacggcctgatgaaattcggcttcccctgggttctggcttacgactctgtcatagacttcatccacatatgacataattttttcctccttagattggtttatacatatttcccttatatgagtaagttgcttaaagggcaaaaaggggccagaacttttgtgagttccggcccctttgccttgtcataacttctaaaaaattataacaagttaatttaataaagtcaataaacacttttcctttattttcttaattttcctttttctttttgctaagtgctgcataaagagccatcatgaatcctgacagggccaccattaccttacccgcagccttttgccggtcgccggtcttaggcagattggcaagaggtacgtttccatcgtcaacattcagcagatcaatggaaccgtcaccaggcaggttggcaaggggcaccgggtccggcacaatcgtcaccgcagcacccggaccgcctgggttatcccttccggaaggtcctcccgatgaaccgccgccgcctctgattctctcatcctgaatggtaatggtaaagctgttgacgccatccagggtcaccggcgggatattgctgttaatataatacccggtcggcgcttttgtttcaatgaaagtataggtgtcttttggcagtctttttattacaaactgcccgtcgttgccggtcacaaaaattcctgcagctgccctgtcgtccgtatatccggcaaaagagccgctatccagcttcacatactttccatcggaagctttcagaatgaactcagcacctttcagcttcacatccgcatagaccgcattggtttttaccacagtaatttttgaaggcatattggcaatagcaccattggtcttttcaaacagccccggtgttgtataccggatttccttattggcttcattaatggtaaattctgcagtccatggagccgttccaagaagatatccatcgggcgacattatctccgtcagacggtaggtgccgtagggcaggtttgttataactccttttccgtttaacacaaaggttatggtatttcctaccacctgatcggccgtccaggcagcgccatctgctgccgcctgattgcggtagctgtcccaggctcccggaaccagggtcgaaaggttcgacagcacaaattctgctccctcaagcctctttccggtgttttcaccgtcaaccttttccatttccagatttccggtgctgatcttattggtcacggtaactgtaacaagagcgtcatttgaaaccactgctgctttgctgttatcctttaagatgcttaccttgccttccccgtcaattctgatatagaacggatcaatggaatcgtaccggtcggaagaagcctccctgatctggtaatcgccatgtttcagccccaggtgaatcaaaccgtcagctccggtggtaaataatcccgtatcagaatccccgtcagtcttaaaccggtttgctccaaaaattgataaaactccattttcttcataccggcccggtcctaatatttcaaactggattccgcttatactgtttccaagattatccgccttcttaagctgaagctcaaactgagcccgttcattaactacctcattgccgtttcctaagtctgcttccctttggtcctctgtaatagtaaactcaaattctgcctttccattcaggcttaaatagccctttggcgccttttcttccttaagaatataggttccgtatgggatttcctttatatccacatggccgtttactgctgtaaaacggatttttccgccttctgtctcaacgtccataattcccattgcctccagctcagcctggctcttattacctatatcctctaaaaaccgctcataggctccgtctacattcgtatccttcctgtttatggagaactgggcagaagcaattttttcacctgtggaactgtctaccttgtcaaataccagagatccggttccataatcgtcggtaacgaactcgtttccgtctgcaaggaccgtataagcctctttgtcgctcagcaaagtcacttcatagactctgtcgcttaattcatagccggcgggggccttctgttccttcacatagtaggttcccaatgggagcatttcagattccccaatgccgccatttcctgttgtcatggtacctgcaagtgctgttaagtctttatcggagtaaatctcaaataccgctccgtcaagcctcatctcatggttgtgggatgcagccttgttaatccgtattttggccatattccttaaatcatatactacaacagtctcggagttgccggatcgcagtacggttatttccgtatcagcagttacgccataattggcaggtgcctgtgtttcctttaaaatataatttcctgccgggagacgttttacagtaactcttccgtcgcttccggtggtaaatgcagaaccttcctcctggctttcctttaatccggtataggagttgtttccatcaagagccacatattttccgtctgcggtcatgagcataaatactgcgccggacagtacctcctccgtcttctgatcccgtttttcaatgttaagctcatgaggcgtattgacgattccattgcctcctgtcagcttcacaccttcagcactttcaatggtaaaagctttggtccatttgcttccgctgttgaataaatatccgtcaggagccttgatctccgtcaaggtataggttccatatgggatctgggtcaaaagacctgtcttggaatctccggttccgtctacctggaatctgatccaaagccttccgttctcattacctgttgatactccggaaacgcccagacctaatacataattctgataagcctcaaacgctccgttgatcacagaagttccgcttaactcaaactgtgctcctgcaatggctttcccggtttctccgtcaatcttttctacggaaagggaaccggtcttgatcacattctttatgatcaggttgatctggttctgttcttcgctgtctaagataagctcgccgcgcccctctccatttaagagagatacttttccattcacatcaattcttacatagaatggctctacaggttcataccccgctgcatccagttcttctattttgtaatccccataaggcagattccatttaataaggccctccccgtcggtttgttttacttcatatccgctttccgacggatcattcagcttaaagtctgccttggcaaacgggatccatgaactgctttcatactttccaggacctgttatggcaaagctgattccggccaccttatcgttaccggcattatctgccttcttaaggcttaagctgtaatcggttctggtattcttaatgaggttatcctcaaggcctgaaagcactgccttctgcccgtcagtctcgatctggaaatcaatatcagcctgtttctttgtaatatcatatccgtctggtacccggatttccgacaaggtataggttccatatgggattccggtcaatgtcacctttccggataccacttcaaactctattccattgctggtttccgttacctttgtcactcccatggatcccggatctgccttcatggcctctgtaaatgccttccaggcatcttccagcacagcaccctttttctcgatcttaaatgctgctccgccaagttcttttcccgttaacccgtcaagctttgtaaattccagagatccggacacatagctgttcttaaccgttatggtgcttggcacgggatttccagacgtcttaaattccttgctgagcagctcccaggctttatggccgtttacctgataagaagtcattggaaccatatcatcggtctgtgcattggcaatctcatatcctgcaggcgcgccatcctctacaacaatataattccggtaatagagaagctctcctgcactccagactgcctcattgttatccagaaccgtattgccctgagcaaccggacttccaaggtctgccgcattcttgattccattttgccggaacccttccatctcctcgttggtatatggaccatatacgctgaaatgggcaccttctaccggatttccggcttcatttgtcttcttaatggttacatttctaaatggtacaaaaccaatatcctttgtcttatcataatcatctcctgccgaccataagaagaagtcttccgatgcataagaatcattggtctctttaaagttgctgtcaaggctctcttcgtaattctttcctccctctgccagggtatcaggaaaccttgatcttcctgcctccgcattttgccctgtggaaagcatagttggttttgtcagtttaagcaccaggtcttcatagcctgcaggcattgtccctgttgtcacataaatccggtaatgagcaggatcctccccctttagctttgacacgatcagggactggttgctgtaccagctgttttcctgttcctgggtgaattctgatcctgtgatgccaaaaggcttcgccggcgtcaatccgtcaaacaggaatctggcatcgcttaagtttactgtacccgatacttcatcatcgccgctctttccgtatttcagcagattgaccttaaaatacttagactgaagcactggaagcaaatctgtaagaagatgatcatctgtagtgctttcatcctgtattccattgttattgtcgtcaatccatatccgtccggatacttttacatttcccggcaccagaagtacctgaaccgcattgctggtctgtgcctgggggaacattatctcagatgtatctgttaagctcttcttatagctgtaagaggtagcgaaatcattaaccgcatatccataagctacatcatccaactccttcttatctgtataaggaacaaccgtcttataggtcaccaccagattctctcccggagccagatagaactcaggatcaatgatcttgatgcggatggccgtgggatcactgaggctttcggaccagaacccgtcattgttatcgttcagcatggattcttttccttgctgggccgttgctttgttgttaaatactgtgcccgaataggtcacctgattgctgaagtcttcaacctttctgccttccttgtgatccgtcctgttctcaattgcaatggatacaatttcctcatacttcagctggtaatcactgtaacgttcaaaattgccggtactgtaatcaccttttaccggaaggatatccatgagctgcagcttggtgataatatcactggcagaggcattgttcaccgtgagccggtacagtacggtaccgtcataattagtaagctccgtatcatctgcgctctttgccacttttcctaccgttgttcctgacacgaacctggtatctaagtttccttttacctccttatagaggaccagccccgtaccggtgctcatggtgttctccgcagaatccgaagcgtatccataatcccggtatttttcatccggcagctgcacatcctttggcaggtcagcgctgggccatttgctgcctgaatctgttttgatcataaaggaagcgccagtctggtttaatgaaaatgcaggctgcagaacatcacttgtaacataaagctcattgagaatgttctttccgtaattgataatgcttcccgcgatctgtgcttttacttcaaccgtaacagattcgcccttatctaagtttccgctgagctgaatgaataaagtctcccgcccggtcgttggatcaacctttttaacagtcttttcaatagcaacaccctgcggcgaatcctttaaggtaacagcctttaacagacggtcctctccagctgattctcctgacacggtaactccaagaggtacgtaatcaataaggataggctctttcatcggcacgatatcagaatcattgcttgtggtatcattctttacataaagggtataagtcaggatatcactaggctgtattcctttaataggatcaacgctctttttcaccgagataatcggtgcctggctctgaacaacctgaatatcacattccgtctttgcctggctcttttcctggctctgcaccaatgttccgttaatatcccaccttctaaagtccatggacacttcggcctcattgcgaatatacttgatttctttcttataggttccgttggacagcttcgcatcctggtgatccagcttaaccgtaacctcaatgcttcccggtacaaaatcatttccaagtacatattggttttccgtggaggcctccagagtgtcatcccgatagctgatctggaaggatttcacctttttaccgtttaccggcttgatcagaccgatctctccgtcaccggataccgcaacgctctgtaccgctcccacctggtttccgttaaaatcatagaaagttacatccgccataatggttccggtccttgccccctgaatgtggttctgttccgtggcctttcccggttttattgaaacaatggtgtatttttcataggtgtactcagcctctggaagttccgattttcccgtatccagcatctttaagcctgtatccgttactacaaaccggtctaaaggtatgctgtttgctgcgttaggcgttaaggtataggtcactgtctggccttcattccaccataagtcctttaaagtggttgtgagagatgtcttatccagtgttactcctgtcttctgttttacatttgtaaactcgcagggatctggaatcacacccttcttaacttccacctctttcctgtaaacggttcttgcatcatccttgttaatgatataaccctggctgttctgagttactgccgtctcttcaataatataagttccaggcagaagctgtactgtagttccggtctccccgtatggtacgttaaccgtatttccaatctgctttcctgtttctttttccgtgaccttcatggaaacagcaatggagctgccaggattatctgtcttatttacatcattcttaataagctttaatggcagcgcttcctggttatgagcctcaaagctatggactcccggtgtaacggtattgcttcctgtgagaacataaagttcaagacctgttttagtttccccgttctttatcacatcagcggttgtgggaaggatggtcccttccgccccgttaaaggaatccatacggaatgtttcaaagccattctcattcttcgtcacctcataaactccataggaatcgcccgccggaagttcaagtccacggaaggaaagctttccttgagaatcactggtaccttctgtaacataattccaggtaccacctggggatcttctgtaaagctcaaaggtgattcctgacttaagagattttgaacctccgttaccgctgtatttggtaatctgtaaatcaataccgccctgattctgcacggtaatttctgttgtttttcctgtttctgctgccagaccttcctcgggtatggctgttgtgattgcaatgtagcctgccggagcgttcacttctttaatatagtaggttccagggctgtagaccttggtggaaaatacgatttcatatactccgctctggcctatctctgtgaagcttcctacttcatttgtcagctgctgatcggaatacagcttaaaggctgctcctgacagcttctttgaatgatttgctccgtctgccttggtaagaagtattctggcctttgcatattcgttgttcaccgtaatggataccgggtttttagaggtaaaatcagtctctacgcccaccttaatgtatccgtcctcctgaagagttccgttttccaccgcgcctgatggcgaaagcatccagtcaggattctcctgctctttcagatagtaggcgcctccctccggattctgaggaagatgcacagttccgcctgccgtgtaataaccagcctgagcttcaaagttccggatctttacctgtaccggactgccggattcatctgataccctcttataggtgttattggaataggtgtaaatatcaaaaacaatttcagaaggaagcttatcagcaatattctcatcatttttgaatccatcgccaaagaaaagcttctttgttatggtcagttccgccttctgtctgttttcaaattcgaccgtaagtgtatcttcatatccacctgccatatctgctacgactggcacaatgattggctgggcatcaatggtatatcctgacggggctttctgttccgtaatccggtaccagccaggttcacagttcttcagcgtataggtgccgtctttgttatctgtcaaagttcttgtgacggaattaaagccctgatctggctttgcatagcctgcatctctaacattctgcagaacccctccgattaaatccgtgtctgagcggaacttcaagtattccactttaaaggtagcacctgccataccagtaccgctgtcctttgtttctgcatcaattttatgaatgattaattccgccagacgtggattcttaaccacagcggttgccagctttcctgttgcgcttcctatgagaaccaaggatacccttccatcaatggctttcgcttcatatccgacatccaccgttattgtttcaaaatatcggtcagttacagtttttgccgcttcgcttcccaatacttctgcctttatggtgtaaacgccgctgaccagattattaaagctggccacatattttccattctcaggtttggtagttttatgaatctcgctgccgcctgatttttggatggtaaaagtgattccgtcaaggtttaccgatggatctccagtccaggtggttttttcaattaccagatccggcttctccgggttatatacgttcacagtggaaggattgcttcctacggtaaaatatctccaaagatcatcttctcccgtatacatggtaatatatttctgctgctggatctctgtcatggtttcctttaaccggtatcgtccggcttgtaagccctttggtacttttacctggccattgatgtccgtggtataagttccgatacttacatagctgtaactgccgttttcccattgatactggtaaatttcaaactctacgccgcttaaaggagtctttggaatgtttaaagcatccagttcttcatccgttttaccaaatgtactggaatccggtacatatccatatttttcaatggtcaccggatactgttccaataccgtgttcatcagacggtactcctcatcttttcccgttacccagaaataatgggaatcaatggaatcctgatttttgggtatttctgcctcaagatagtgaagcgttgggtccatttgtaccttggaaggcgcatatacctcctccagtccaaagagggcctttacaacattatcattctcaacctttaaaattctgtttacttcatctccaagtcccttattttcaagcgcatctttaagcttacccatgttgatcatcttagaaagggcatagccggttttgttactgtcatcggattccagaccggtttcaaccacttcaattggaagcagcttttctttactgtcaggctctaacagccatatctggaatttggctcctcctaaaagagttggctcctcactgggctttaaggcatctttcagccatttgtttaatttaatctggaaatagtatgcatcatagcctcccgggccatcctcatgctggtttttcaccacaacaggctctttgctgcgcccgttttcatactcatgaagcataccgtcatatccggtgtggccggatccttttggcacaaagaccgctacgatttggggtccgccgggaagctgatagcccggcgccggcgcttcctccaccagccagtataccttaccgggttccaaaaccgctgtatcaaattctccgttcaccctgctgcctgtttttggatcacccctggtgccgctctcataactgtctaccttttcaaaccggctttcatccgccagatctgccaactggattcccgagagattttttacatctcctgtcatcttatagagggtaaactgggctccattaatattttccggctgatgggtagttccatcaactgcgttaccatcacaggtttttaatacgttaaactgaacccaaggcttgtagtttaaaagatcatcggtcttctgaattaaagagtccgcgtctttgggaagatctttgcccgaatattccactgcattgtacttgccttctcttaattctgaaactgaaagggttttaggaggttcttcgtctccatttgccaaaggtgtcttattacccatattcagctcaaaatcaaaaccagtttcgtccttggtgggcacccgcacttcaactacaaagtaggtatcattccggttaatgttatagaaggtcgcaatgccgtcataagcattagtggttactgtttctacgtagtcagccttagtaatatcatctgtatttaccctatagagggccagttttacgtttccaaggacatgatctaccttatagaattgataattccattcatccctccagtacttctgagtgcggatggtcagcttgggttcattcttaataacaagctggctgccattttcttccccattaaccgttgtaatgaccttgccttcctttaaagtggtcgtcaaaatttcataggaaggcagatagccgtttggaggtgttatctcagcaatgacataggaaattctgtttccgttggtatcaaaaatcttaagttctgtgctgctaaaggttgcctggccagctgttggttcggttccactggttgtcaccgtctcaattggattgctgatgcttgcttcccaattatttacatcaaacttatcagcttcgaaaataccgaaaactgcaccattaacagaacgatccctcagcgcatcttttttagtgactgtaacttttccgttatccttataattcactaacggcttatcaggtcctgccagataaatttcctgctttgtattgcctgcagacgctgcagttatgtcgactggtccataatatatatttttttcaaatatcttataaccaggatggtatccttctgttttgtcatcatctgagagcaggtaataaggattgatattgccgtctgggaccttttctttaaaataatagtttccaggagcaagaggaatcggtgtattggaattcaaactgcctgtttcctcaaaaccacttcccacctcattctcaacataaatttcaaatattattgtgtctattttggaatctttatttccatctgcatcgtattgtgtctttttgatagtaaccaatttatatggttcatttttaaaggtcttatggttctctgtgttatctttggcaaaccatctttctaagtctgtttttctcacaggcccatcgggagtgattaactcagccttttccccttttacaaaattatccggtgccactgtctcttcaatgatatatgttgttccaggatcaagggtaatataggttccttcagtggatacccaatcatcgaaagccactttctcaggattactatcttttaccgttattttaaaacgtgctgaaatagaattatcctcatctgtaatatcaaccttataaaaccagtaaggaaccttttgaggaatgttataggcctctacaatagtatcgctttttctgcttactgcgtaaggaccgataaaaatctggtcacctgaggtttccacctttgtaaaattctctgcttccaatcttccggtaccgttaatctctgaccagtagtattgttttgttacatcaaggccctttaccagaatttctcccttactgtctgtcgtataggtcgttgctggcaacacttcggtgaaattaccctcgtttttataataaagcttaaactgaaatccacttttggaagcgttcttatccagggttccatcctcagtgtcaacagaccatgcctccttctgaagctttaaggttccacccttattattttttaaatttacctcagcaatttctaaaggctttagagaaaaggtcttatatatataagtcccatcctccttttcctcttgtgaaaaaccggcttcattcccatttccgtcggaatatccttccggtactttttcagctaccctgtactcgatctcattgccgcttccatcataaacaggcagagtcaccgtaaactgactttcacttcctagagagtaggtgattctaacttctttggtgattttgtcttttatgctcacctgttcccatgtaccagctaccttcttctcaatccagaacctatcattaaaatcctctctgtaagcctctggtacatttatataattatcattgtcatcctgcatcagcttcgtaactcttacttttgcttgatttaacgtgttgacaagaaaattatccccgtcttttacaggcgacgtcacatcagcgtatacagttacctcatactcatgattatcaataatataaccattagcgcttttctcttttacaacgtattgtcctggcgtaagaggcttaaacagcacatatcctttattgtctgactctacagttttaacctctgtgagacttccatcttcatttttctgataaagagtaaattcggcctctttcaagacatttaattccgtctcgctaacagttacactatcccaggtacgagcctttttgtaaaactcaatagctccttttccaataacttcatttacaaccgtaacctcggcgttttcacctgcctttaaggtgaccttaatatcctccccattggcaacaggttttgttcccacctttgcggaattgaattgggtcccaacaggtttttcagtttccttctctttaatcacataggttcccggatctacctgaatctgaatgtaaccatcatcttctgttgcgtaaaatccgctttccgtttcatcatttgaaggatttaccacaatgttccgattgttaattttttgacctttactgtcaatgactgtataattgtcataaggtatttgattattgtcagcatccacagaataaatctcaaaaccggccaatcccggatactccttctccatatccaaaccatatttctgagtaactcccaggccttcgtcaatttccttctttatcttaatgactgccggcttgttaaactcatggaccgcaacattcacatcagaagcttccgtcaccgtctgatccgttcccagctttacatattccagataagccttattattaaccgtaaaaacatcattgttctcaacacgttcatcattgtacttcagtaaaaacggttcatagggatagcgggccgttactaaataggaactgtaggtgggcgctgattctgatacataaatatgatcctctccactctgtcccttggttttgaattcatcaattgtaattgatccgtcttcattttggatcatgtgaacatcggatccatctccccacttcgctgttacggaaaccggcatcatggcctccggagcattttccgtgacaatcttaagagagtccgttattttaaaagatccctcctgaaaaccggttctcccatacgtttgataaacaactccgtccggctgacgggatatggtatttgagcttccgtacataccgacttcaatcaaataggtaatatccacaaactcaggatttctctctccgtctcttaccactgtataaggatcaccagttgaatttaaactctttttaatatgccaaacgtcatcagacacaagggtcagtgtggtttcccccggctgatttgcataagtaactgtttcaatatttcccggatattccacatgttccgtatctgtcttatccgccaccttaacatcggcatagaaagcaacgctgttctcagacaaattaaactgctcgccaaccgctctttttccgtttccgtcaatataggcattcatggttatgctgtctgatttgcccggtcggatcacattctgctcatctcccacgctgatttcgtaaaccttgccatcatcgtcagaggagatcagttctactttaccaggctgctcttctatgataatgccggcaggcacggtaaaccggatttttgcgttctcataagcatcaaacagagaaagctttccgcctgctgcatattcataaagaggtgctgcctgcatggtataagtgatggtataggtatataaaacgcctgccttaatggaacctgtttgactttgagaaaggcttacttctacggtttccttctcatccgtggcatcaggcccataataagttaaagccgtttcataaggactaagcttaccttcaccgcttatctccgtattcaacagggtgattccatagcttcgtacgaccataccaaaggacggcttgctgagaaaagaaaacaagctggtcttcttttcctctccattgagggcggccacatccgttcccataagggcggcccgttcgtcttctgaaaggaccttcgtatcccctacaaaaacaagatcagcctcttctccaagagagtcatcaatctctgcttcagaagccgttgccaatgaaccttcagaactgaaaagtaccggaaccttatgccttgttactgaaatcccattgattcctatgctgcttacagaaagggcagccccggatttttcagaatcagaatctccgcttttttcttcctgcccggcatgatcctgattttcttttccagcttcttccttaactgcttccttagcatcttccttagctgcttccttagccgtatcattttccgtatcctttggctcttccacagcttcccttgaattctcttccttttgggcctcagtcacttcaccggcctggtcttgtgtttcttcatccggttcggaaagattcttatcagcctcaccggtttcctgagtctcggtttcctgggtctcagtttcctgagcctcagtttcctggtcattggtttcttcttctgttccatccgttgtttcctggcttactgaacttccggtatttcctgaaccacttgtgcttcccgaattcacagaattccccgatcgagtcccggctgaggatggctgtgcagccttttcttcctgagaattttctccaatgactgcaaactcctccatatgggcatctgttatcatcaaatcatccccgacgatccgcaaacggaattcgcaatcccggtccttatagccgttcacacctatgacctggatatttttaaggatcgaatcctgtttgatcctttcagacttatgggattcgaaaaaaggttctccatccaaagtatcggaaaccaccaccagatacatggcttttccaacttttttctggagcaccagagtctttccctccagttcttcatacaattttcctataaccagatccttttgatccccttcaaaaggaaccagatcttcgtttaattccggccttctgtcaaaatcctttttaagaaccttctcaatggaagactgggttacctgaacatcgataatcctcgccgcctctgatggtgacgcctctgacggagatgctttccccacattggaagtagattcgctcctgctttcagcaagctctgaagcatatgcggtggttatggaaagctgtgatatatttcctgcaacaatcgcagccgtcaataaccaggcaatagcccttcttaagcgatgcactttcttcactgcacctttcatacttttatcctcctttatttgttccatcttaaggttaaaatctattaatagacaaaaagctgtattttctttttattcagtatatataccgttggttacagattggttattttttcctcattttatctattttgttttgaaaccatttttcaattgttaacctaatattaattataggttgacaattgtttttgcatgtgttaccattccagtagaatttatattacaataagggagcatgatcttatgaatacagcgaaaacctttgaaaccaagacctcatcccctgccagacgccggatttcaacaaaggaactggttctggccggaatgtttgcggctgtccttgccgtgatttcccagatatccattcccttaccaaccggtgttcccattaccattcagatatttggagtcgctcttatagggaccgtacttggatggcggctgggatttttagcaactcttatttacatccttttaggagccgttggcctgccggtcttttcaaactttcggggaggaatccaagccttggcgggacttaccggcggttacatatggggctggcttattatggtcatcctatgcggaatcaggccgaaaacaggcagtaagcccttaaacacagtccttatgtttcttcttcccatcctgggaactctcgtggatgaaaccatcggaggacttcaatgggcggcattatccggagagatgtcggtcttaggcgtattttcctactccatggtggcattcgtgcccaaggacatcatccttacggtaattgctgtcatcaccggaatccctgtccgaaaagccattttacggcaataacaaagattctgaccggccggcgcctgcaaaggcgccggctcttctatttttaaccatattcttaaggcttgacagaaacggctttggaacttaaaataatttcatatgtcttaataacaaataatccaaaagaaggttttccacatatgattcaggatattttcccctatgtatttcataacgaatttgaaataaaaacacctgaaacagacagctatttcctgtatttcctggatggccgtctcctccttaacaaaaaaaaatcagcaaaaattccccaatttgaagacttaaaaagcctgggtgaggaagccatgtcccactcggactaccttttttccattgatcagatggattttttccttaccgatgaagccatggtcaccctgacagaaacagattccctggcattttaccagaccggcagaataagagacctagagcccatgtgggtatcctttgcagctgtttccgccatgcagcttcaccgtttctacggctccagccggttttgcggctgttgcggttctcccatgatgaaaagcaaaaaggagcggtccatggtctgctcctcctgcggaaatactgtttacccgaaaatttccccggctgttatcgtggccgtcactcacaacggaaaacttttgctgaccaaatatgcaggaagagaatacacccggtatgctctgatcgcaggctatacggaattcggtgaaaccctggaagaaaccgtaagccgggaggtgatggaggaagtaggtcttcgggtcaaaaatatacgctactataaaaaccagccctggggcttcagcgattccattttagttggatattgggctgagctggatggttctccacaagtctgcctggatgaaacagagttatccacagcagaatggatggctcctgaggatatccctgacgacttcaccaacttaagcctgactcatgagatgattcttctctttaaaaacaggaaagtaacttaaaaagtaatatttcaacaaaaaaacaccgcggtacggcggtcaatcagctgccgtgctgcggtgtcctttttctatggtacccatctatttcctcagatatgtttatgcttcaattccaaatgcaaatacaaaaggccgacccgcaattgggaacggccttttgccacctatttaaacttatttaccgtagtaagcctttaaatacatttccttgatctcactcataagaggatatcttggatttgcgcctgtacactggtcatcaaatgcattttcaaccatttcatccagagtatccaggaagtgtttctcgtcaatgccatattccttaatgcttgccttgattcccactgctttctttaattcctcaatctttacaatgagtttcttaagcagttcagcatcatccttgccttccacgccgcagaaacgcgcgcactctgcatatcttgcaagggtatgaggatactcatactgtgggaaagttcccattttagtcggaacttcacaagcattgaactccatgaccaaggtgatcagaagggcatttgcaacaccatggggaaggtgatgataagcgcctaatttatgagccatagaatggcatacacctaaaaatgcattgttaaatgccataccagccatacaggaagcatctgccatcttacatcttgcctctacgttggttccgtcgttgtatgctgttggcagatagtcgaatacatttttcattgccttaagtgcaaggccatcggtgtaatcggaagccattacagaagcataagcctctaatgcatgagtcataacgtcgataccggaagcgcttgtaagacctctgggctggctcatcatgttgtctgcatcaacgatcgccatatccggcattaattcatagtctgcaagaggatatttcacccctgtttcctgatcggtaataactgcaaatgaagttacctcggaacctgtaccggaagaagttgggattgccacaaagtaagccttttcacccattttagggaatgtgtaaactctcttgcggatatccataaaacgcatggccatatcctggaaatccacttccggatgctcatacataacccacatgatcttggccgcgtccatagcggaaccgccgcccaaagcgataatggtatccggctggaatgccttcatagctgccgcacctgcctgggcatttgccagagtcggatctggctggacgtcggaaaataccgtataaacaatgcccatttcatctaatttatctgtaatcggtttggtataaccgttcatgtaaaggaaggaatccgttacaacgaatgctctctttttattatatacatcctttaattcgctaagtgcgacaggcatacagccttttttaaagtaaaccttctccggatttctgaaccacagcatgttctctctcctctcagcaacggtcttaatgttcagcaaatgctttaccccaacgttttcagaaacagagtttccgccccaggaaccgcagcctaaggtcagggatggctgcagcttgaagttataaatatcaccgatgccgccgtgggaggatggggtattcactaagatacggcaggtcttcatagccgcagcgtgctttgccatcttctccttttcatttacatttacatagagagaggatgtatgtccgtaaccgccgtcagcaaccagctgctccgccttctcaatggcctcatcaaaggtcttggccttatacattgccagaaccggagacagtttttcatgtgcaaactcttcctcaatgtgaacgttctcaacctcaccgatcagaatctttgcatcttccggaacctgaactcctgcaagctttgcaattgtgcaggctttctggcctacgatcttggcgtttaacgcgccgttgatgatgatggtcttacgaaccttatccagttcatcaccctttaagaaataacatcctctggccgcaaattcttttttaactgcatcataaatagtttcaagaacggttacagactgctcggaagcacagatcataccgttgtcaaaggttttagaatgaatgatggagctgactgccatcttaatatcagccgtatcatcaatgataacaggggtatttcctgcaccaacgccaagggctggttttccggaagaataagcagccttcaccattccggggccgccggttgccaggattatatcagcacttctcatgacctcattggtcagttctaaggaaggaacgtcgatccagccgatgatcccttccggtgcgcctgccttgacagcagcatcaagaaccacttttgcagccgcaatggtagaattctttgcacggggatgaggggaaatcatgatggcatttctggtctttaagctgataagggttttgaaaatagcagttgaagtcgggttcgtggtagggattaccgctgcaaccagaccgatcggctctgcaatcttcttaatgccatatgcctgatcttcttcgattacaccgcaggtcttggtttctttaaatgtattataaatatattctgcagcatagttgttcttaatgaccttgtcttccacaacacccatgccggtctcttctacagccatttttgcaagaggaattctcagtttattggcagcacttgctgcctcataaaagatcttatctacctgttcctgggtgaaggtagcaaatactctctgagcctctctcatggcttccatttttgcgatcaaggcatctacgctgtcaatgatctggggaacctttacctgttcttctttctttgccataataactttcctccaattttcaaataagttaaataggtatttttatatcgatatatttttaacaatctgttatggtttcattatatgatatcgttatttttttgtcaatgttgaatctcacaaaaatatacatagttccggttaatttttattcatatctcatatttttaaaataaatacaaagattccttcctcctccctgatctttctcatataaaatatattttgaacatctcattagagctatattattatagaaaaagctgtttttttgtcgattttttatgcttaacaggctgaataaagcttttgaacggatttaaaaacttggcaatacgaatcaggtatggtatagtatgccttagaaccataagatcatttagtgcttaaatgtgattatgtcacctcatacgctgctctattacaggtcagatgagattgttttatatataagaataaggggatttgagaattatgaaaattacgatagggattgatcttggaggaagcaccactaaaattgtaggatttcagaacaataaattaaaaattcctacttttgtcaaagctgataaccccattgcttctctctttggagctcttggaaaattcatatatgaaaataacattcagttaagcgaaattgaaaaaatcatgatcacaggagttggcagcgcttacgtggagcagcctttgtatgggattcctacttataaagtaaacgaatttacctgcaatggtctgggaggacaatactttacagggcttaatgatttgatcgtcgtaagcatgggaacaggaacctctctcgttcaggtaaacggagataaaatcattcacaccggcgggatcggcattggcggagggaccatcctgggcctttcaagcctcctgctaaagacccaggatatttcccagatcatggagctggcaagccggggaaacataagcaacattgacttacagatacaggatatttctaaagcgcctcttcccggccttcctctctctgccacagcctctaatttcggcaaggtacgaaatcttgtgtctgatgaagacattgccgtgggaattattaatatggtgcttcaggtcattggtaaatctgctattttatcttccttaaacagcaatatcaccaactttgtcatgacaggaaatcttgcaaaatttcctcagtgcaaaggtattttccagtcccttgaaaccatgtttcacgtccatttcatcataccggaccaggcggaatacggtactgcaatcggagctgccctaacagaagaacaccatatggaaatgagacagattttatatccagaggaaaaaacacaatcataagattattgtaaactaattttaaaaaactttttctgctatatacttagttaaggggatatttcttatcctctacactatttgattacagcgtgccacgcttcacctgaaatgaccaaaaagcaacttccatccatcacttaaagcctttcttatttgatgcaaagacttacatgattcggcggtcattctcagtatccgagaagttatgcaacctgacaaagttttttcattcacagtatgtcacttcctatttataaaaaaacaggtacagcaaaagccgcacctgtttttttatgaatgataacctaatgcctgctccaaagcatccttttcttcgcttcccagcaagacatctgtttctcctctttccacttccttgatgtatacataacagccttcccggctgtgcacggaattcaatacaaaacctgaatttgtataatcaaggattgccattgcaaaacttaggtttccgcccatccctttaaacgcattatattttataagtccgaatttctggaaagcgcttctgtaatttttgttggtattgcgaagagaatccttattggcccggtcttctgactttaattccgcaatatcctccatttgctccataataatgtcttccagagtttccgcatcttttcccctcataaaatagtcgtatctgcgatacagctttctcatctgaaccagacatatgattacaacgatcagcaatatgatggtaagcacagctaatccaataatcaaataagcaggatcaaccgataactgattcaatatactgttgtccattctttcgtcctcgcttccatgatgttatcttatggattctatcaactctactattctttccaattctgcctcagaatagtactcaatttccactcttcctttgtttctatctttccgattaatgcttacctttgttcccatggcagttttcatgcggttttccaattctctgaaaatcaggaaaatgctctcatcctcttcctttttttcctttggctcttttttctttgatatggatttaacaagcttttccacttcacggacgcttaaattttcagcaacaattcttcctgcaatctggaattgtaattccggatcatcaacagccagaagtgccctggcatgtcctcctgtgatctgattttcaatcagcatatcctggactcttttttccagctttaataaacgcatgctgttagtgatggtcaccctgtttttcgccaccctggctgcgatttcttcctgctttaatccaaattcctgcatcagcctttgataagccttggcttcttcaatgggatttaaatcctctctctgcacgttttcaatcaatgcgatctccattgattgctgtttcgtatattcccgaatcaccacaggcacttccttcagacctgccagctttgccgctctccatcttcgctcacctgcgatgatttcatagaaatccccctttttttgtactaaaaggggctgtaaaacaccgtattccttcatggattccgctaattccatgagggattcctcacgaaagtccattctgggctgatgttgattcggttcaattgaagatattttaaggaacatcccttttcctgtttccagttcctcttcacctgattcttttttttccattgttttttccggcttcgaacggtttttcatctcctgttcctctgccgcagactccattacttcatctccaaaaattgctccaaggccttttcctaaacccgttctctttgccataattatatttcttctcctctgcttattacttctgccgccagtaaccggtagctttccgctcctgctgatctggaatcatataaattaatcggcattccatggctgggagcctctgccagtctgacatttctgggtataatggttttatagatattctggtttaaattatttttaacactttctacaacttccagggaaaggtttgtcctggcatcgtacatggtgaaaactacaccctccatttccagagcaggattcagcttctttttcaccagatttacggtcttcaatacctggcttaatcctctaatgcataatattcacattgaattggcaccaatacggtgtttgcggctgttaaggcattaattgtcaatagattcaatgacggaggacaatctatgataataaaatcatagtgtttcttgattttttcaagatatgttttgaggagtgtttccttgttttcaatttccaataattcaatctctgctcccgctaaatccacgttagaaggaagtaaatccagattttcctgaacattggtaatcagacattcttcaatttcacactctcctaccagcaaatcgtaaaccgttcgttcaatggagcttttttcaattcccagtccgctggtttcatttccctgtggatcaaaatccacagccaatacccgttgtctggattccgcaagacaagcagatagattgatcgcagttgtcgttttaccgactccgcccttctggtttgctatcgcaatgattcttcccatttttaattttgcctcctgatgaatcaaaggaatattctatccagttgattcataaattcaaggttgaaagacaccttctttcaaccttttcctgttactacatccgaaacttgcagttcaaagtagagtatagcatattttatttttttttcctatggtttcctgtaaaaaaaatctataaattacaaaaaatgtttcacgtgaaacattttgctatttttatatcagtgaatcaagcggatttatacacacatccaatcaatccacaagcttaaagttaataaatgcttttctttcaacctttactccatgattcctgggtataaaggccaagttttaagaataaattaatatgttaggcgttgtaagtccatattgattatattataataggaagagatcaacctatttcaggaggtaaagtatgaaaacaaagaacaaactattgaccctgcttattttatcagccagtacagcagtcaccactgctatcattaataagtgcattaaatattccgccacctccaaaaacatattatggattcaaaatccttgtgctataaatggcgttttggcaacattcattatacaaagacaggaactggaaaacctcttttactgattcatgatttaactacatgctccagcggatacgaatggagccagatgatcaaccatttaaaagaacagtataccgtatacacggtagatcttttgggatgcggacgttctgagaaaccagatctcacctataccaattatttatatgttcaaatgatatctgactttattaaatcagaaatcggccaccgcaccaatgtgattgcatccggttcctcatcagctcttgctgtcatggcctgcaatcagtcaccggaattatttgatcaggtcatgctgatcaatccggatactttactggcatgcagccagataccgaataagcatggaaaggtgtataagtttattttggacttgcctgtattaggaacactgctctaccatatagctaccagtaaaaaagcaataatggaagaatttgcttctaattatttttataatccatattcagtaaaaacatcattggtggatgcctactatgaatcagcccatttaggagattctccaaaatctttatatgccagtgtgaaatgcaattacactaaatgtaacattgtaaatgctctgaagaaaatcaataacagtatttatattattggtggatgtgaaatggaaaacgtcagtgaaatgatacgggaatatcagatttacaatccagctattgaaagctccctgatcagcaactccaaatatcttcctcaattggaaaatccttctgaattgcatcgcattattcaaatgttctttgtttaactagttcaataaaaataataataaaatggtaaaaaaataatgtttcacgaaacatccttaagctatcagctcagtaatcatacataggatgtttcacgtgaaacattttattttaaaggttccttagatggcaatccgcctttctaggatatttttttgaagtaccattactcttaactattttaaccaatgacctttccgcatccgttcctggcagtaaaaaggttttcacctcttcaatatttccccctaataaaaatacggcgtgttttgctgctcccagctcttcctcaatcttccctgatttatatggaataaaatagccccctatctttacaaaaggcatacaatattcggataaagtgctaagattggctactgctctggaaacacaaaaatcatactgctctctatgagatggatctcttcccagatcctctgctcttccatgaatggcttctatcttttcaagccccatactgctgatcacttcattcaaaaaatttatccttttgtttaaggaatccattaatgttatcttcaaatcaggaaatacgatctttaatggtattccaggaaatcccgctccggtacccacatcaataatcttataatcctttgtacctatctccctgactgcttttacaagggataagctatccacaaaatgttttgtgatcacctcagcctcttctataattgcagttaaattcatatatttattccactccaccaataattgaaaataatcatagaattgcttcattttattttcttctaactctatagataataaatttaattccttccggagattctcttcaaacgcttctgtcatacaaagtccctcactctttcttttccaggctcttctggtaccgaagctgttccagaaaaacaagcagcacagatatgtctgatacgccggatattctggatgcctgtccaatggacatgggcttatatagattcagcttctggatggcctctcttcttagaccttttaccgtggaatagtcaaattccacatccagctttttattctccagctttttatactggtttacctgctgtttctgcctgcggatatatccgtcatatttaatatttatattgacctgttctatgacatcctctgaaagttcaggtctgtttctatctattttagttaacataatataatccagctccggccgtctcaccagctccgctacagtcgtacctgtttttaaaggagtgcttccattttcctctaaaaactcctggacttctttggatgcccctatattagtggtttccaaccgcctgatctcttcttcaatcagccgttccttttcaagcagcttttcatactgctccttgcttattaatccaatgtcatggcctattttcattaaacggatatccgcattgtcctggcgaagcaaaagcctgtattccgctcttgaggtcatcatacggtatggctcatgattctcctttgtaacaagatcatcaatgagaacaccgatataagcctgggagcggtcaagcaccacctgctctcttcccagtatcttcatggcagcatttacaccggccataaagccctgaacagcagcctcctcatatccggagcttccattaaactggccaccgcagaacaatccgctgataaccatggtttccatagttgacttaagctgtctggaattgatgcagtcgtattcaatggcataagcatttctgacgatcttcaccttttccaatcccggaactgtccggtacatggcatactgcacatcttcgggcaaggagctggacatgccggctaagtacatttcattggtataaaggccctccggctccacaaaaacctgatggcggtccttgtccggaaatttaaccaccttatcctcaatggatggacagtatcttggccctgttccctcaatggccccggaatataagggagaacggtctatattatcccggatgatctggtgagtattttcattggtgtaagtaagccagcaggatatctggtccttttgcagggcttccttatgggttgaaaaagaaaacggaaccactttttcatcaccaaactgctcttccatcctggaaaaatcaatacttctcttatccactctggcaggagtacctgtcttaaagcgcagcatttcgattccatgctcctttaaggaatccgtcagatgattggccgccttaaggccgttaggccctgtatattcgcttacatccccgtaaatgcaccttgctcttaaataagtacctgtagccaatactgccgccttacagcggtagactgccccggaaagggtctttactcctgtaagggtcccatcctctgcaatgatctcagaaacctcagcctgccttatggtcagatgatccgtattttccagggtcattctcatggctctggaatattcctgtttatctgcctgagctcttaaggaatgaacggccggccctttggactgattcagcattttggactggataaaggttttatcaatatttttacccatttccccgcctaaagcatccagctcccttaccaaatggcctttggagcttccgccgatattggggttacagggcatcagcgcaatgctgtccacgctgactgtaaacataatggtctcaagccccagccttgcacaggccagagccgcctcacagcctgcatggcctgcgccgactatgacaacgtcataagactcttctaaatgctgcatttcgttctcctctcctatctattgcccacgtttctgagcaaaaaaatccactgtcaattcttattggcattgaaataaacctgtatggttatttcccggacattcccaaccacaactttttacttacccatacagaacttacggaatatctcattcaccagatcatcttccaccgattctcccaggatggttcccagctgctcataggcatccattaaatctatggaataaaaatcctcaggcatctcatttttcacgctttcttccaccatgaaaaggctcttaagcgcttcctgaagggcattcttatgtcttacattggtgatgtagacctgatcattaaaatcaatctcaccatgataaaacatggccttaatctcattctccaggttcccgatcccaatctgttcctttgcggaaatgggaatcacccgatgccctgtccttgagtttatcatatcctctgtaacaaccggtatgaggtcggttttatttaaaagaacaactgccttcctgttttcaatgaaccttaagatctcctcatcattttcatcaagaggacaggacccatccaccacataaatgattaaatccgcttcctgggccgcgcttctggccttctcaacgccgattctttcaaccacatcctgtgtatcccggattcctgcagtatcaatgatattaaggcttaaatcctccaacctgatctgttcctttaaggtatctctggtggttcctgcaatatccgtcacaattgcccgctcctctcccaccagaacatttaaaagagaggattttcctgcattgggttttcctaaaataacggtttcaattccttctgaaaggactctgccattatctgaagacttaataagaagatccagctccttctttaaaggttccaaagtctgcaaaagaagctcccggtacccatccagggaaatgtgttccggatcatcaagagccgattcaataaaagcgatatgataaataattttatctctcatgtcccgtatcttcctggaaacagctccctctaactggctgacagaagactttaaggcataattattttttgcatgaatgacatcaatcactgcttctgcctgggataaatccaccctgccgtttaaaaaagccctcttggtaaattcccctggctccgcaggcctggctccgtattttaacactgtctccagaatcctcttggtcaccaggactcctccatggcaatcaatctcaaccgtatcttccgccgtatagctgcgtggccccctcataataagaacaagaacctcatcaataacctcatccccgtcacaaatgcagccgtaatgaatggtatgagacggctccatggaaagctttttctctccttttccctttgtcttaaaaatccgatctataatttgaaatgactcttcgccgctgatccttacgatcccgattccggaactggacatagctgtggcgatagccgctattgtattcattttcatattttgtctcctaatgaatcaagcggataagtctgtatatcctgttgattcacaaatttaaggttaaaaaacaccttcccgtgaatagccgctttccaaagaaaagggggtgaggtgccttccgacagccccaacccctcattgttatttgtctatttatctttttcctgataccggtcctttttggaataatctttttttaaagaaataacaacatgcctgaatggctcttctccctcacttcttgtaaccacaaatttgtcattctgaagtgcggagtggatgatccttctttcataaggattcatcggttccagagaaacagaacgtcttgtccgcttcaccttgtaagcgatattttttgcaagagtttccagagtttcttttctccgctccctgtaattctccgtatcaagctttaccctgatataatcgtcattttccttattaataacaaggctgaccaggtactgcagggaatccagagtctgtcctctcttgccaattaaaattcccatgtcatctcctgacatgttaatggaaagctctttttccttttcattataggaaacttccatatgaactcctaaattcatagcgccgaacacatcggaaagaaaagtcacagccttatcttccaaggtttctttcttctttgcacggatgatagccggtttgaaaccgataattcccagaataccattactgcccttatcaacaatttcatactccagcttatcactggttgtccctaattcgattaatgcctttgtaattgcttcatcaacggtctttgctgaaactgtaatcatatccataggtcaccctcctatttattattgtgcttttcgttgtacttctcaaccatcctcgcctttgatgcaatgctgcccggatttgaggctccgctgttataataatcattggaagccttaacctgttcctttgtcttttcagccttggcattcatctcagcttccgccttttcattggaagtctgaagattctttaaattagctgtggcattctgggcaacacgctgaggcggaagccccttcttagcacgctttttattagccttttccacattcttcttaatcatatcatccatatcaatctggtttaaataacggtttaccgcaacctgctgaatgatctggaacacactggaagcgatccagtaaataccgatacctgatgcaaaagtgaaacagaaaaatacggacattaaaggcataacggtattcatgctcttcatggactgagccattgcaccgccttcatcatttgtattctgaggctgatttactgtcatcagcttggtactgaaccactggctgagaccggccagaatagggatgaggatcgcaaggctgaactggaaaccgcctcctggcggaaacatcacgctggatggcgtagaagccagattgattcccaggaaagaattcatgtgggaaatctgggttgcattggcagcaatggtatccttgatggttggaaataattcctgcatagaactccactggctgggatttagctgatacagaaaatctaccattccattgctggttgtaaggcttccgattcttgatacattgattttattatccgtggcaaactgtgtcagcatccctacgtgatctactccaagggaattaatggcagtcaccacattttcaaatactgcctttacgctctgtacataggcaggaatatgataaatgacctgatacaaggcaaaaagaattggcatctgaatgacaagctgcacacagcctcctgtcatggaagttccgtatttctcgtaaaccgcctgaacctccacattctgctttctcatggattcctgatcggtttttcctttatattttgcctgaatcgcagaaatttccggctgcataacgctcataagctttgatgatctctgctgctttaaagtcagcggaaacatgagaagctttgttacaagagtaaataaaataatacataaaccaatattctgaataccaaatgtgctggtcagcttaaacagccaatccataataacacccagaacggttgcaaacggccccaggatgcctcctaccttagtcaatactaagaattccaatgaactacctcctcatctgttacggaactggatcataaccgccttttgcaaagggattacaccgaagtatcctcttgcaagccaaaaatgtaccctttaacacgccgtactttgtaagcgcctcaatggcgtattgagaacacgtaggcgtgtaaatgcagtgagttcttattttcagaggagaaagatatttctgatatcctctgatcaacaaaatcatgacttttttcaccataagatcacttcgattctttttttaaaatgttatgaagtccgcacaagtgcagatatgcactttcgattgttttgtaattttcttcctttgccgctgttcttacaacgactacgatgtctaatcctgtctccaccatttcctcatgaagcctgaagctttctctgatcaatctggttatgtgatgcctcacaacgctgtttcctaccttcttgctgacggatatgccgattctggtttccggcctgtccgtttttttaacatacatcacaagaagtctgttggcaagggactttccgttttgataaacttcctgaaaatcccggctttttttaatcgaattaaaatgtttcatgaaactttttcctatctcctgtccacgtcttttggacaaaaaagtatacctggaaggtattttcctgtttccccggaatttgagaaaagaaaaggccacaattacttgcggcctggtccattaagctgataattttgctcttccctttgctcttcttgcggctaaaacttttcttccgcctggagtgctcattctggctctgaaaccatgaactttggatctctgtctcttttttggctgaaacgtcatcttcataatctacggacacctcctcttgttacaatagcttatcataggcaatatgatgaaacatattgagactatcttaattaaacatcgtttcaattatatagaacaaaaggtggttcgtcaagggaaaaatgtattttttcttttgaaaccagcactcttccggcttttttgcagagcattcctgataccggattaaatacttaactgactttccttcccatataccggaaaaatcccataatgtccgtccccagcctatcaatcaaatcatttatacagtataattagatatggaaaatatttctatttattaattggatagacatggaaaaaacgctcttatgaaaggatggtttgcaaatgaatcgtgaaaaaatcaatatcagggatccctttgttctggttaatgaggggaaatactatatgtatggaacaagggctgaaacatgctggacatctgccacaggatttgactgctacatcagtgaagatttagaaaactggagcggtccttacgaagtattttgtaagccaaaggatttttgggccgatttaaattgctgggccccggaagtacataaatacaacggttcttattatatgtttgcaacctttaaagacagtcaatgccatgggggaactgcaattttaaaagcagaccatcctttaggaccgtttatcccacacagtgaaaaacaaatcacgccaaaagactgggaatgcattgacggaaccttttatgtagacccggaaggaaaaccctatatggttttcgttcatgaatgggtccagatttcagatggttccatctgtgccgttgaacttagccctgatttaaaacaggcagtgtcccatcccatactgctttttcacgcttccgaagcaaaaaactgggtcgtcccagtaaaaacaaaagacccggtacaaattatgtaacagatggtcccttcctctaccggaccaaaagcggccgcctgattcttttatggtcaagttttggaaaggaaggatatacagaggcccttgcttattccgacaacaatgatattacaggaaaatggattcaggatggcaggcttctgtttgaaaaagacggaggtcatggcatgatatttaagaacttatccggtgaactttatctcactctccatacccccaatgaacatttaaaagagcatccagttttttataaactggaagaaacagacggcacgctttgggtcagtgaaacgtaatactcttcgggcatacctttatgcccgataaagggggacgggctttgcccatgagaaagaaagaggaaatatgaaagaagtgatttttacaggaaaatgcgggggaatcggaatcagccacgtggccagagactgtgacctgtctgaaaccattgggttttataaaaatgaatatcagatttattatatcctggatggagaacgttttttctattcaaataataaaagctacaggatgtcaaaaggcaccctgtcttttattgataaaaaaatgattccttttaccaatgtaatcggcggaaagtaccacgaaaggatattaatagaaattgaagaaacatggctgatctctgcaggaagtgtcatggaactggacttaaagggatttttcactgatttacacggcgttcttcagatgaattcccagcatcaggaagtaattgaaaagaagcttaagaaaatagaacatattttgcaggaaaaaagaccttatgctgcagcggaagtaaaagaactgcttctttccatcatcataatgattctaaacggagccggaaccaggccggatgaataccatactccaggcggtaaaatgatgcgctatgccaaagtgaaagaaattatgtactatatcatggagcattattctgaaatctatggtctggaggatctggcaggcatattttaccttgataaaagttatttaagccgcatctttaaagaagtgaccaattttacagtaaatgaattcatcaaccttcagaaagtagaccgtgccagaaaactgctcttagacgagtctctttccatagaggatatatcgaaaaagttaggatatgaaagacattcttactttgaccgtgttttcaaaaaatacacagggatgtctccccttcaatatagaaaatccaggaaaaccacataactccagtcaatttagtgaaaatacgaaagtttttttgatgtattggcgtattgcccaacatatgttgttatttcctattaaaaacagtaaaatatatccatataaaatcaaatccggatttcattattgtatcatttaagcatcttttcaaaacgtaaaggaggttagattgattgaaaaagatgaaaaaattctgtggggacaattttatcccctatatgttcctgcttccctggcttataggaattctgggactgacggtttatcccatgttcatgtcactccgcatgagttttacggattacgatttcacaaagcctgattcggccctttggatcggtttcggcaattacataagaatgtttggttctttatttggcatcaccgattttacggcgccgtcaggaaaaataatgagggttgacccatactatttaaaatcactgtcagtgacatttacctatgtatttacgtcagttcccttaaagctgatatttgctcttctggtggctgtactgatgaatcaaaaactgcggttcgtatctttttaccgtgctgtatactacattcccacactgttaggcggttctgtggctatagcggttttatggcgaaagctctttgaaaaagaaggtctgataaacggaatcctttcttcaattgggtttacggatctgccaggctggatcaccaatccaaaatatgcactgggaactctggtgcttcttacggtatggcagttcggctcatcaatgatcatttttctggcaggcttaaaacagattccaatggattactatgaagcagccagcgtggatggtgccagtaaagtccagcagtttttctcaataaccataccatcgcttacgcctgtcatactgtttaaccttgtcatgcaaatgatctcggcattccagacatttactcaggcatacatcatcggcggcggcaaaggcggagtcttaaattcaacccttttctatacccttcatttatatattcaaggatggacctaccatgaaatgggttatgcatcagcaatggcgtggatgcttctgattattataggctcatttacggcagtcatattcggatcgtcaaaactatgggtctcctatggaaacggggaataatttatgagagcgaaaaaacaattccatatcatactgacacatatttttatcgtaacactgggaattactatgctttatccggtcatctggatgatcgtcagttcgtttaagcccaacaatatgatattcagcgacaccggcctgattccaaaagcaattaccattgaaaattatatcagcggctggaagggctatgcaggtgtatcatttggcaggttttttttaaactccacgcttctgtgcataacagcagttgccgcaaatctcgtttcatgcaccatggcagcttatgcttttggaaggcttaagtttttcgggaagaacttctggttcggtatcatgatgataacgcttatgcttccggcacatgtcaccctggtgccccgttatatcctttttaacacctttggctgggtaggcacctacctgcccatcctgatccctaaatttttagccactgacgcgttttttgtatttctgctggtacagtttataagaggacttccaaaagatttagatgaagcagccatcatagacggctgcggaaaggtgggaatattttttaggatcgtaatacctcttgcagggccggccatggtaaccaccgcactctttaccttcctctggacatgggacgattttttcaatcaccttctctaccttacgtctccggaaagctatacggtatcccgtgccttaagaacctttgtaggcgatgcgggagccgtatcaaactggggcggcgcacttgccatgtccactctcgccatgctgccaagctttattttattcttttcacttcaaaaatattttgttcagggcatcgccacatccggaattaagggataaagcccttttaatcaaataacaggaaaaggagaatattatgaaaaaatcgtttcaactgctgttagctgcctgcacagttctttccttatggggatgcagttccaatactgcttcagaaacaacacaagcaccggcctcagctcccacagaatcacaaaaaacggaaagtgaaccggctgacacagaaggttttcccgcctataccggcgaagccgctgaactgcgtttcagctggtggggcaatgacgaacgggctgccctcaccaatcaggtaatagaccggtttatggcagcctatcccaatatcaaaattacaggagagcctaacggcggtactgccgatcactttcagatcatcgatacccagctgcaggggaataacgctcctgatctgattcaattcggaggcaattacccggattacatacagtatctcacgcctcttaacgattttctcggtaagcagcttctcatcaacactgccggacagtttgaccaggtggcccttgaaacaggcacttcagatggaaatctttatgccgtcagcctgggaaccaatactcctgttcttgcctataacaaaacactgatcgaatccgcaggtgcttctgtcccagaatacaatttaacctgggatgaactgattgactacggcagagagttaaagaccaagcttcccaatggagtgtttccctttgttgacaacagcacaaatcaggcgaattacttaagctactactgccagcaggaaggaacacccttatggacctctgatcagggcggcaaaagctatatgacactggaaacctcaaaaaaatggatccagttatgggccgatttgcggtccgaaggactgatcccggattccgatactactgcaacctatgcggaaacaggggctgacagctctgctcttgtggcaggcaaggctgcgatcggaatgatatggagcaatcaggtagccggttatcaggcagcgatgactgatcagcttggggctaccacacttccggcaggcggagaaaaagcatatgccatccaaatgagccagtatcttggaatcaacaaaaacagtgcaaatccggaagcagcggccatcttcattaattattttgtgacaagtccagaagccggagagattcttggcaccaaccgcggcattccctgttcacctgttgtacgtgaagcaatctccgaaaaagccacttccgctgatgcggctgtctatgctatttatgatgccatcagcgaccgttccattccccaggggcccaatctgcccaatgatcaggaattcatcaatgaattacacttaatcggccagaatgtgtcctatggcagcatttccccggaccagggtgccgcagatctttttgatctgatacaaagacttattgtaaaataaaaacttaatcagcaggagaaaccgcttggcttctcctgtttctataaaaaagctttttctactggaggcaaaatttgaatatccaaacaagtgtatcatttcagacttcttatgaacttttgcaaaagcttatggactcagccgaaaaaaaaacatggaataatttaaaatatttcaattccaggcttgtactgatcgaaggcggggggtacgaaaaaatatggctggaaacccagcccatgggcggagaaatgtacgcaaaaagaaatatggaagccggactgaataaccatcttttgttcatggaaactcaacgggaggatggaagatttcccggaagcattgcttttatgaatggaaaaatcactcctcagtttgataaatttcagggattctgcttcccctcttctgctcttaatatgtattatctaatagggaaagatccggaatatttaaatcttctctatactaccctggaaaaattcgacgcttatctctggaatgtaagagattctgacggagatggatgtctggaaagctggtgcaaatacgatacaggggaagaccatgctctccgttatggggattcaccggattcctggagtaaagaagttcccccaaaaagctctcagatcgtacccatggcctccatggacattatgagcttttcttattcctcaagggaaactctgtcaaaaatatccaccatacagggaaatgaaaaaagagcggattcctggaaaaaaaaatcattatcaattcagaaaaaaatcaaaaattacctgtgggatgaaacaaaaggtgcctgctttgacagggaccggaatcacaatatcatgaatgttatgacccataacaatttaagagccatgtactggaacagcctgacccaggacatggctgagaactttgttataaagcacctgctgaatccggaagaattctggacctatatgccgcttccatccattgcagtaaatgatcccctattccgtaacattcccaccaatgactggagcggacaatctgaggcacttacctttcagcgggcaatccgcgctcttgagaattatggcttcgatcatctggttccatatctgggagaaaagctgttccaggcaattggagatacatgcatatttgttcagcagtacgatccttttaccggcaaaccatccatagaatccctggaaggcatacaggactcctatgggcctgccatgctttctgtcatggaatacgcagcccgcatgtacggaatacatatcgagcacgaacggatttactggggaaccacaggcggacacgaaaatatttatgagcaggtctggggaaaccacacatttaaaataaaaaactcaggatccaaagcagaagcctttgtcaatggaaaaaaagtttttgaagccggaaaagacttaaagatcattacagatataaaaggaaatccattgaatttaagacagttgaatacatgcgctgatatcagaaatataaaaacttttttataattcactatatatatagtaagagccattgctcctcgaaatgattcattcgagaagcaatggctctgtttttaacagtaattaccctttcattgccttaaatagggcctgtgtaaccgctaccgtaagaattccagccacaatggcctcaggaattccattgatgcatataattccaataattacggaataaattccttctgtcagtccctttgccgcctgaccgtattcttttccaaaaaataagtaaatcagattcattaccaaaagagtattggttaatgatccggctactcctgcggccgccaaagcgatggtcctctttccgtttttctcacccaaagcttttaacaccgcccgaaaaacataataggctacgattccaacgagaattctgggaaccatgcaaatgatcaggcttcctatatttccgccgtactctcccactttaataaaaggtgaaaatacaaaggacgtaggattgggcatgttggtatttttccacaaactggtaagtccaaataccattcctaaaaatccgccatattttggtccaagaataatggctccaattatgaccggaacgtgaatgatggtggcgttcataaatcccaagggtatgtacccaaagggcgtaaacgccatgatgacgataatggcaacaaatacggctgccagtaccaggctacgggttttgttttcaatattcatttttttcctcctgtgctactgttcttttataaagatacaatgcatctggttacatgtgcattatattatagaaagctttcatccgtcaatccacgtcagtaaattcacgcccattttgttaatttacataaacttatcaacattatggggataacttgtggaaaactctatggatatcatcttgataatcgtcgttttattcacaggcctgtcctgagagcccatataaattccacttttccggactgtgaatatccaaacttataaaacacaccttttttgtggacaactatttctctggatgattatcaacatatgattcacatgcaatacacatcctctgcacacacttatccacaattttttactattatcattgaaaattatttcaaaatagtatagaatgaactgtagattgggtaaatgcgcatatttgcatttttataaatgtaggagacttacgatgttagaaaagttaaaggaaaaatgggatgaaatcttattgaatttaaaagaagagcacgaaattacggacgtgtcttttaaaacctggcttcttcccctgaaggttcattccgtgaatggcgaaaaagtcattgtcacggtaccggatgtggaattcttaggatacatccgcaaaaaatacgggtttcttctgaaaatcaccatagaagaagtgaccggctttgaatgcagcgtggatttcgttgttgaaagtcagattcaacaggagactgtttcatctcctgcaggcaacactcttattaataataccatgaattcggtcagccagacggctatcacaaatgcaaacctgaatccaaaatacatttttgatacctttgtggtaggtgccaacaacaacttagcccatgccgcctccctggctgttgcggaatctcctggtgaaatttataaccctctgttcatttacggaggcgttggtctgggaaagacccacctgatgcattccattggccatttcatcttaaaaaataatcccagggcaaaggtcctctacgtgaccagcgaaaagttcaccaatgagctgatcgacgccatccgtaataaaaacaacttctctcctacggaattccgtgagaagtaccgcaacaatgacgttctgctcatcgacgatatccagttcatcattggtaaggaaagtactcaggaagaattcttccacaccttcaacgcattatacgaagctaaaaaacagatcatcatttcctcggacaaaccacccaaggaaatcgaaacgctggaggagaggcttcgttcccggtttgaatggggcttaacagtggacatacagtcccctgattatgagaccaggatggccatcctcagaaaaaaagaggaaatggaaggctacaacattgataatgaggtcatcaaatacatagccaccaacatcaagtccaacatacgtgaactggaaggcgccctgacaaaaatcgtggccctctcccgccttgacaataaggagatcaccgtagaactggcggaagaagccttaaaagacatcatctctcccaacggcaaacgggaagttactccggagcttgtcatacaggtagttgcagatcactacggcctcactcctcttgatatttgttcccagaaacggaacaaggaaatcgtttatccacgtcagatcgtcatgtatctctgccgagaaatggttggaacccccttacaaatgattggaaaattcctgggaggaagggaccataccaccatcatccatggaatagaaaaaataactgcaaacgtggataaaaacgaatctttaaataacaccattgagatcctgaaaaagaagattaatccacaataaggtgtgtattagctgttaattccctgtggataattaaggtcctaaaactgtttctcatgttcctgtggataacttcaatgttttccttaacttttgtggacgttattcacacccttatgaacatggaaacatcagcctttataaaggttatcagggcttttacacaaacccacagcccctactactaatacgacggaatttaactatatcatccatctatttattgcaatttctagagcaaaggagttatcaacaattatgaaactgacatttaaacaggatgagatcctaaacggcattaatatcgtattaaaagcagttccaagtaaaacaaccatgtccatcctggagtgtatctttattgatgccagcggatcagagatcaaactgacagccaatgacatggagcttggaattgaaacaaaggtagaaggtaccatcctggaaaggggcaaaatcgccctggaagcaaaactgctttccgagatcgtaagaaaactttcttctgcaggagattccctggttaccattgaaagcgatgaaaaactcaccaccaccatttcctgtgaaaactccgtattccatattcagggacgggatggagaggaatttgcttatcttccgtatattgaacgggatcattatatctgcttgtcccagttctctttaaaagaagtgatccgccagaccatcttttccattgctcccaatgacagcaataaaatgatgacaggagagcttttccaggttacaggaaaccagttaaaggtggtttctctggatggccacaggatttccatccggaatattgaattaaaagatacgtatcatgatataaaagtcattgttcctggcaagactttaaacgaagtcagcaagattctgggcggagacaatgaaaaagaagtacttattttcttcagtactaaccacattttatttgaatttgacgatactatcgttgtttcccgtttgatcgaaggagaatattttcggatcgatcagatgctttccagcgattatgagacaaagacatcggtcaataaaagagagcttttggactgtcttgaccgggccaccatcctggtgagggaaaatgataagaaacccctgatcatgaacattgaagatcaggaaatgcagcttaagatgaattccagctttggatccatgaacgctaaagtccccatccataaaacgggaagcgacattatgatcggctttaatccaaagtttttgatcgatgccttaaggatcattgatgatgaagaagtgaccctttatatgctgaatcccaaatctccctgctttatccgggatgaagaaggaaaatatatttatctgatccttcctgtcaactttaatgcggcagcagtttaaaccgtccttatggcaggaaaacggcaggatataagaaaatcctgatttatggcgtgcagtccgcgcctctggatagagaggaacgccctatgggcggcagagaggaaactatggaaacgatcaagttaagggatgagtatatcaagctgggacaggccttaaaggccgccggtatggtaggatcaggtgttgacgccaaatttgtcattgaggatggccttgtgaaagtcaacggccaggtggaataccagagaggaaagaaattaagagctggagacgtagtcacatttgatggcaataccattaagatcgaggaataacaccatccatgataattgaatcgatagagcttaagaattaccgcaactatgatgaattacatatggattttagtcagggaaccaatatactctatggggacaatgcccaggggaaaacaaatgtcttagaagcaatctatgtctgtgctacgacaaaatcccacagagggagcaaggataaggaaattatacaatttgacagggatgagtcgcatatcaagctaaatgtcagaaagaaagatattccatacaggatcgacatgcatttgaaaaagaataaagccaaaggtgtggcggtaaacggcgttcccataaagaaggccagtgaattgtttggaattgtcaacgttgtatttttttctccggaagacttaaatctcataaaaaatgggccggccgaaaggcgccggttcgttgatttggaattatgtcaactaaacaggctttacgtccattcccttgtgcaatacaaccggatcgtgacgcagcgcaataaactgttgaaagatatggcttttcggcctgattatgaagaaaccctggacatatgggatatgcagctggtccagtacggaaaggaaatgataggttatcggaaagaatttatagaacaactggatggaatcattggatccatccaccggaagctttccggggaaaaggaacacttacacatcctctatgaaccaaacgtagaggctgatgagtttgaggataccataaggcgaagcaggcagcaggatatgaggcagaaaacaacgcttaccggtccccaccgggatgatttaagtttcatcatcaacggaatcgacattcgccggttcggttcccaggggcaacagaggacagctgcgttgtccttaaagcttgcagaaatagaactggtagaaaaaacagtatatgattaccccatccttttactggatgacgtattatcggagctggataacagcaggcaaaatcaattacttgccggaattgatcatatacagaccgtgatcacctgtacgggactggaagaatttgtgaaaaaccggtttcctgttgataaaatatttaaggtggtaaacggtaccgtaggcaatgaaaattagttacagtttggccatgctgccaaattataacgcaaataacgattcaggaggaagcgtgcaaatatgagtcaagaatatggtgcagatcaaatccagatattagagggtcttgaagcagtaagaaaaaggcctggtatgtatatcggcagtacttccacaaggggacttcatcatttggtttacgagatcgtggacaatgcggtggatgaggctctggcaggatattgcgacagcatagaggtaattgtccatcctgacaattccgtgaccgttgtggatgatggacgggggatccccgtaggaatccagaagaaagcagggataccggcagtagaggtagcttttaccatcctccatgcaggcggtaaattcggcggcgggggatataaagtttccggcggccttcacggcgtgggcgcttctgtagtcaatgctctttcccagtggctggaggtagagatccgccaggatggaaagatttataaacagcgttatgaaaaaggaaagaccatgtaccccttaaaggtgacaggagaatgcggccctgatgagcatggaacaacggttaccttccttcccgacggggatatttttgaagaaacggtttttgattacgataccttaaagatccgtctccgtgagacagcattcttaaccaaaaatttaaggattatccttaaggatgagagagaggaaagccatgagcacgtgttccattatgaaggcggcatcagggaattcgtcacttatttaaacaagggaaagaccccgctttatgatcaggtattttactgtgaaggaataaaagatggcgtttatgttgagatcgccatgcagcacaatgattcctatacggaaaatatttacagctttgtcaataacatcaatactcctgaaggaggaactcatctggcaggctttaaaaacgctttgacaacaaccttaaatgattatgccagaaagaccaagctgttaaaggaaagcgaaacgaacctttccggtgaagacatcagggaaggtctgacggctattatcagcgtcaaaatcgaggagccccagtttgagggacagacaaagcagaaattaggaaacagcgaagcaagaggagcggtggataatctcttaagagagcagttcacctattatttagagcagaatccaagtatttcaaagactatctgtgacaaatccatcctggctcagagagcaagagcagcggccagaaaagccagggatttgacaaggagaaagaccgcacttgaggggatggcccttcctggaaagcttgcggactgttctgataaaaacccggaaaactgcgagatctacatcgtagagggagacagtgcaggcggctctgcaaagacggcccgttccaggaatacccaggctatccttcctttgagaggaaagatcttaaacgtggagaaggcaaggcttgacaagatctatgccaatgcggagatcaaggccatgatcacagcatttggaacaggcatccatgaggactttgacttaagtaaattaagatatcataaaatcatcatcatgactgatgccgatgtggatggtgcccatatcagcaccttgcttctcacctttttataccgctttatgccggagctgatccgggaaggttatgtatatctggcacagcctcccttatacaaggtggagaaggggaaaaaggtatggtatgcctataccgatgaggagcttaactccattctgagggaaatcggccgtgacaataacaataagatccagcgttacaaaggtttgggagagatggatgcagagcagctttgggaaactaccatggatccggagcgaagagtccttctgcgggttaccatgaatgaggataccacttccgagatggatttgacctttaccaccttaatgggcgatcaggtagagccaagacgtgaatttatcgaaaccaacgccaaatacgtacagaatcttgatgtttaataaaaagcgagtgttgaagtacaaaggcacttttcgtatctaaagggatacgtggattgaaataattggaggaaataaaatggaaccaaatatctttgataaagttcatgatgtggacttaaaaaagaccatggaaaaatcgtatatcgagtatgccatgagtgtcattgtttccagagctctgcctgatgtaagagacggtttgaagccggttcagcgtagagtcctgtattccatgattgagctcaacaacggtccggataagccacaccgtaaatgtgcccgtatcgtgggtgataccatgggtaaataccaccctcacggtgacagctctatttacggagctctggtgaatatggcacaggaatggtctaccagatatccgctggtggatggtcacggaaacttcggttccgttgatggagacggggcggctgccatgcgatatacagaagcccgcttaagtaagatttccatggaaatgcttgcagatatcagcaaagataccgttgatttcagccccaattttgatgagacggagagagagccggatgtacttccgtcccgttatcccaatcttctggtaaatggcacctccggaatagccgttggtatggctaccaacatccctcctcataacttaagagaggttattaatgcggtcattcatattattgacaaccaggtggaagaaaacagggaaaccaccatggaggagatcttagaaatcatcaaagggccggatttcccaacaggagcaaccatcctgggaaaacggggaatcgaagaagcatatcgtacgggaagaggaaagattcgtgtcagggctgtcagcgatattgaaaccatggcaaacggaaaaagccggatcatagtgaccgagcttccctatatggtcaataaggcccgccttattgaaaagatcgcagagcttgtaaaagataaaaaggtggatggaattaccgacttaagggatgagtcagaccgttccggtatgaggatctgcattgagcttcgccgtgatgccaacgccaatgtaatccttaaccagctgatcaagcatacccagcttcaggatacctttggtgtgatcatgctcgctcttgttaaaaacagttccggcgttttagagccaaaggtcttaaatatccttcagatgttaaattattatctggagcatcaaaaggaagttgtgaccagaaggatccgttatgacttaaacaaggcggaagaaagagcacacattttgcagggcttgctcattgccttagataacattgacgaagtcatcaggatcatccgtggctctgaaaatgtccaggcagctaaggcagaactcatgagccgctttggcttaagcgatgtccagtcccaggcaattgttgatatgcgtctgagagctcttaccggtttggaaagagaaaagcttgagaacgaatacaaggagctggaagccaggatcgaagaattaaaggccatccttgctgatgaaaaaaagcttttagcagtgatcaaagaggaaatatccatcatttccgcaaaattcggagatgacagaagaacctccatcggctttgatgagtatgatatgtccatggaagatttgattcccgatgaaagtaccattgtagccatgacaaagctgggatatattaagaggatgtctattgataacttcaagaatcagaaccggggcggcaggggaatcaagggaatgcagaccattgatcaggattacatcgaagacctgatgatgacaaccacccatcattacctgatgttctttaccaatacaggccgtgtttaccggttaaaaacgtatatgatcccggaaggaagcagaacctccagaggaaccgccattgtaaaccttttgcagatgcttcccggcgagagcattacggccatcatccccatgaaggaatacgatgatgacaagttcttatttatggcaaccaaaaacggaatggtgaagaaaacacctatgaaggaatatgccaatgtccgcaggaacggtcttcaggctattgtccttcgggaaaatgatgaactgatcgaggttaaggccacggatgatacaaaggacatcttcctggtgacgaagaaaggccagtgcatcaggttccatgaaaaggatgtccgtattacaggccgtgtatccataggtgttatcggcatgaagctcaatgaggatgaccaggttgtaggaatgcagaaggaatcccaggggccgaagctgctgatcgtatcggctaatggtatgggcaagcgaactcctattgaggaattcacacctcagagaagaggcggaaagggtgttctgtgctataagatcacggaaaagacaggagacatcgtaggggctaagttagtacaggatgaccatgatcttcttctgatcaccaccgaaggaatcgttatccgaatttctgtcaatgacatttccgtcatcggaagaaacacttccggagtaaaactgatgaacattgaccaggattccgatattaccgttgccagcattgcaaaggtacgggatgacggaagcaaatccgatggagaaggtctggaagaactggacatcgtggatgtagaacttccagaggtactggacgatgggaatgaagaattcccggaagagataaccggtatagatgaagcctctgatgaggaataaaaaaattaacacaaaggatatggtaatattttaatttttatattataatattaaccatcaataatcagcagtaaaagactttgaatgcagcaatattaactttactgcggtcaaagtcttttatttattgaaatttagcaggaaaacctgcatggacaaatatgtcctaaaaaaaggaggaataccagcttggacagtgacccaggcgcggcgcagatagccgcacagattttattattaattgctttaaccttaatgaatgcgttttttgcaggagcggaaatggctgttgtatcagtcaacaaaaacaggatccggatgctggctgataacggaaataagaaggcagctctgattcaaaagctttcagaggactccaccggtttcctttcaaccatccaggtagccataacctttgccggtttcttctccagtgcatcggctgcaacaggaatttcacaaatactgggagacaaaatgcaggtcttaggcgttccctacagccggagcatctccatggtaatagtgaccattattctgtcttactttaacctggtattgggagaactggttcccaaacggattgcattgcaaaaggcagaacggttcagcttgtttgccgtacgccccatttatatggtatcaaaagtcatggcgccgttcattaggcttctttccatgtcaaccaatggaattttaaagcttcttggaatgaagacggaaaatttagaagaagaagtgtctgaggaagaaatccgttccatgctccagacagggcgggaaagcggtgtgttcaacaagatcgaagaggatatgatcacttctatttttctctttgacgataaaagggccagagaaatcatgacccccagacaggatatggtggcagttgatatcaaaactcccatggagcttttcattaatgagatatttgacagccgtcattccaggattccggtttatgaagaagaaattgataatattatcggtattttatccataaaggactttatcattgaattgaataggaatgagtgggcggatattgatatccgtaccattatgcagaaaccttattttatcccggaaaataaaaagacagatgacttatttctggatatgaagaatggtaagatcagaatggccatcctggtggatgaatacggtggagtatccggtcttatcaccatggaagatttgattaaagaaattgtgggagatattccggaagagtatgaagatgaagagccggagctggtcgaagtagaacctaacgtttataaagcagcaggaagtatttccttgtatgatttggatgaggttcttcatgaagaaattgaaagctcctgtgatacgctgtcaggatatctgatcgaaatacttggttttatcccgaaggaatctcagcttccattggaaatggaggatgataaaaatcaatattccatattggaaatggatgataaggtgataaagagtgtgattgttcgtataaaggaaaaataatttatatccaatataaaaagttgtccggctttcaatacccggacaacttttttagttcatcaagtaacgaagaggaaggtccacccgatgatgcggggggcgctgtgacccttggtcattgggaatatccgattgacttcatagggaatcaaaacctttaggcatgaatacccacaacgctgtactaaaaagttacttccaggttatcggtcagcatttgaatgaatgtttcatgatctctcacctgaatcagttttttaatgaactcccggtccgtcagcatcatggtaagcggttcaaagatttcattgaaaatgtgacggtcatttttgttaaagcacatcataatgacaagataaacaggctttccatcccatgaaacaggcgaatcagaaatcaggatattcagtcctgttttttccgcatgcattttcattgcatggggaattgcaaaatcgtggaaagcagtggaagaaagtttttcacgcacatagatatcttcccggaacgtctcgtctacataacccatccggtgcattttacgggtcagatattcgattgcttctttctctgtttttaaatcatttcttctttcaaagaattcaggtatgatcagggtttccagataatttttaaaggttgtttttttcttattaattctcacggatgtaatcttatttctgattacggaaatatccttatccgtaaaaaacattccgatatggacaatatccacgccataaaagtcatggagcggtacagttgacataataaaatcaaatttaggaacctgttccagaccattctcatccgttaagatgttggttattaacatttcacaggaaaaatgatggttaatggtatctgtcagacgtatattcaaatcataatagttagggcagtataaaacggcagtcacttttttatttaaacttttctgggcttccagagtgcttcctaagtgaaaggtgatataggcaatttcatcgtcattgatgatgatccccgtacggtctttgatgattccggacaaatatacggagacatcataaatcagagggcaggaagttttaatttcttcggttaaaggattttttgaaaattgctgattttttgatcgttgaagcagattcctgatatgaatggcaaaccgaatcagaaattcaggctctgttaaatcaatataataataagcattaaccgaccggatcatttcttctaccagatcaaagcattctttcccgataaagtccaccagatttgcagtggttatgcttttataatctatggtggtagccctggaaatcagcagcagggcaagttcatagatctccgctttgctgtaggtaatatgaaaatggtgttccagctgctttatgacctgacttgccaactcatattcgtgataccgtatctgagtcagttcctggacatcctgagtattaatattgtgatttttgattctgtcaatggctatggtgatgtggagaacaatattgataagggaataatcattgacaaaataatggtattgatcaaaaatattcagcaatgtgtttttgatatactcaatttcaatatcaggaaacacatgttgaatggttttaaggcttacaaagttaatattggattcatcgtataaaatagagcttagcaagcggcgtttatttttttccagcccttcaatggataaattatccttttgattgagaagttttaaatcaaactgactcagcttcctttttactgctcccagctcattctttaaagtggagtagctgatgtatatggtatcgcatagatcgtatgcgtgaatgccggcttcctgtttgatcagaagattgataatataaaccagcctttcctgagaggactgggggatgtgggtgccggaatcatttaagatttttcttccggcctctgggtcaatggaatatccctttctggaagaacggattgtctgaggatcgtggatgttgatctcagaaatataactttttatactacgttccgatacccccatttcagcagctaaagcagaagctgtcatttcgtttgtgtgcatcagcagaatgcgtattaatttcagtaattttgtccccatagtaaaaccctccttctgtctattataggagtatggaaagaatttttccaccagagatttgcacaggaagcgtgcaaatctctggtggaattttaagataaaaaaagtcataatgagtgcatcaactattatgcagattaaggaggattttatttatgttaaaggttttgctggtttgcggatccggtgcaagttccgggtttatggcggctaatataagaaaggcagcaactgcaaaaaaagtagaggtcagtataacagccagaggggaaagtgagattgaaaactatattgatgaaatcgatgcccttatggtaggacctcacctggcctatattctggatgaaattgaggaatatacaggcggaaaggatgtgaaagtcattttaatgaagccggaatactactcaacattaaatggagagatggcattggagcatttattaagtgaaatgagctgagtgaataaggaggaggaggagaaagatgaaacagttaattcattggttagaacacagttttgcaccgaaaatgaacaaaattaataacaatgtctgggttaccaccttaaaagattccattatgcaggtgcttccgtttattttgttaggatcaatcttttgctttttaactgttccggggatgtgtttggctggcaatggtggcccaatttctggactccctttggctggacaatgggattgttatcattatttgttgcatttttaataccatttaacttaatggaaaaaaagcgtctgcgcaaacaaagaatcattgcagcactttccggcgtggtagcatttttgattattatttctcctcaggtgattaaggatggtgtccctgggtttgggcatgcgtctttaggggccggagggatgttcgtagcgattaccgcaggtgttttttcaggtttgatcatgggtctattcggaaagttctcattctttaaagagacttctgtaatccctgactttgtaagagcctggtttgattccatgctgccggcagggatcattgtttgttccctctgggttttggtggatttacttgggatcgatatctataatattgtgctgtcattgtttatgccgatttccaatgttatgcagactccctggggatttgccctttctcttttacttgtttgctttttatattccctggggatttcaagctgggttctcacaccggtttataaaccggccatgcttatggctattactgcaaatgtgagcatggcagccgccggaacagctactcacgaaacattgaacctggttactgatcctaccgtatactctgcatatatctggatcggcggaatcggatgtaccttgcccctggtcattatgcttatatttgcaaaaagcaataaattgagagcattagggcgtgccagctttgtacctgcagtttttaatatcaatgagccggttgtgttcggatgcatcgcatggaatcccattatgatgatccctatgtggctgatgggaatcatccttcccacagtagtctggatttttacaaaggtcattccatttgcacctattcccaccagggtttttgatatgtggtattgtcctttccccatttcaacatggctgacaacgggaagcatcaaaggcattattttaatggctgtttgtgcattgctttcaaccgtaatctggtatccatttttccgtatatatgacagccaggaggctgaggcagagagaaaagctgaagaaaagaaatagagtgatcagaagggtgataaaaatggatgaaaaaacattagaatctgcaatgagcattattatgaatgcgggagatgcacgcttactgtgcaaagaagcattgacagccattgccgatcaggattttattttggccaacgaaaaaatgaaagaagcgcagaaaaaaattacagaggcccaccggatccagacggatgccattcagggagaaaccagaggagaaaaagcggagtattcattgattttcgcccatgcacaggataccctgatgaccatatacagtgaaatcaatattgcaaaacaaatgatcaaaatctttgaaaattgggaaaaacgtttgaaacgcctggaagatcaggaatagaccggtaatatcaggaaggaaaggagaacatcatgagaaaagtaccaaaaggttttccatcggatttcatgtggggaggcgctgtggcggcaaatcagctggagggggcttatgacctggatggcaaggggctttgccttgcagatattaatgaatttcaaaaggatctgcccattgaaaagcgttccaatggggaagtgaccagagcatatatagaagaggccctgcaaagcagtgataaaaatttcccaaaaaggagaggcattgatttttaccatacctatcctgaagatttaaagctgctggctgagctgggactgaaaacattcagaacttccattaactgggccagaatttatccaaatggtgatgacgcacagccaaatgagaaagggcttgaattttatgataaattatttgatgagatcattaaaaacggcatggagcctatgatcaccatttcccattatgagatgccgcttcatctgaccacttcatacaaaggctggtattccagggagaccattgattttttcgtaaactattgcaaaacagtatttgaccggtatgctggtaaggtaaagtactggatcattgtgaatcaaatcaatttgatcggtcatgaatcatttaaccaccttggaatcgcagaagatgtggttgacgatctgcgctctgcaaaatatcaggcagttcatcatgagatggtggcatgtgccagggcaacaaaatacgctcacgaaaaatatcctgaaatgcagatcggcatgatgctgtgcggagggccggaatacccggccacatgtaaaccagaggatgttttggcagcattaaagcacaatcaaatggagtatttctttgccgacgtattgcttaggggatattatcccggttatgcattccgattttttgaggactggaatattgatattacctttgaagacgatgatgaagaggatttaaaaaataccgcagactttttctcattttcttattactacacccagatatgttccaaggaaagctatgacaaagggaatgaggcatacaggaacaaagaactgccggcaaatccctggggctggagcattgatcccattgggctgaggattttgttgaatgaattttatgacagatatcagaaacctgtttatataactgaaaacggagttggctattatgatgaggtagaaaatggcgaaatccatgattcctacagagtggaatatctccgggcacatattgagcagatgaaggaagccattggtgacggggtggatctaagaggttattatgcatggggacccattgatattgtttcctgctcttcctgtgaaatgagtaaacgttatggttttatttatgtagattatgacgactatggaaatggaacaggcaaaaggatcaagaaggacagttatgcatggatgaaaaaagtgattgcatcgggcggtgaggatctggattaacaggaggtgctttgtgaagcagtttgaatttgtagttcaggatgcaatggggatacatgccaggtcagcaggagacatggctgcggcagccaaacagtttacatcccttataaaattaaaaaaagaagagaaggaagccgatttaaaagatccccttgctattatgagattggcaatcaagcaggaagagcgggtgataatatcagcagcaggggaggatgaaaaccaggcaatccagcagttaaaggatttaatagaaaaaattggattaaataaaagccgctgaattccacgaagtaaatgaagtccgcttgacaatgatccggcaaattgataaaatataaactgaaactatatcaattacagatcaaggatgttcgatttgccaggcggctcatcgaacggttgattttctgagtccggtcagcactgtgtttggcttcacgaagaagatcatgcctatgaaataggggattcgtatgacaagtgagtttgcagtagcggttcatggagtagtttatttaaaccagaggaaagccaccatttccagtgaagaactggcttccaatgtatgcaccaatcccgcccgggttagaaaagtgatggcaaaattaaaaaaggccggaattattacaacaaaggaagggctggagggcggctatcattttgcaaaagattcctctgaagtaaatttaagaagcatttgtgatgctttggatgttacctttgtatcttcttcctggaaatccggaaatgtagatactccctgtatggttgcttcgggaatgtcagggatcatggatgaaatctatggagatttagatgagctttgcagaaaaagaatggaagagcttacgataaaagatattcaggaaaaattgatccggaatcgtcttggttctgaaaataaggcagggaatgataaataagacatcccctgccttattttatgtttgaacttgatttcataatgagaatcatttatgatgaaataaaataaaggggtttgtttatctggaggaatatatgatcagaacggttaatattgaagaagtaacgaagaacataaaggaaatgtgtatagaagccaatcatgtgctttcagatgatatggaaagcgtatttcttaaggcagtggacaaagaaaactccgctcttggcagacaggtgctttgccagttgaaggaaaatttgaaaattgccagagaagatatgattcccatctgccaggatacagggatggccgtcatttttatgaaaatagggcaggatgtgcatatagaaggcggaaatctcacagatgcagtcaaccagggtgtaagaaaagggtatgaagaaggatatttaagaaaatcagtggtggagccggtggagcgggtgaatacaaaggataatactcctgcggtcattcattatgaaattgtgagcggagataaaattgatatcacagttgcccctaaggggtttggaagtgaaaatatgagccgcattttcatgttaaagcctgcagatgggctggaagggattaaggaagctattttgacttccgttaaagaagccggccccaatgcctgccctcccatggtcataggagtgggaatcggcggaacctttgaaaaatgcgcccagatggcaaagcacgccttgaccagagatcttgaggaaaagcctttggtaccttatgtaaaggaactggaaaaggaaatgctggagaagataaacaagctgggaatcgggccaggaggcttgggaggaagtataaccgctttagctgtaaatattgaaacctatccgactcatatcgcagggcttccggtagccgtcaatatttgctgtcatgtgaacagacatgcccaccgcatcatataatcattgcagcaaaggttaaaaaacattttttaaccttgggacagtgaacaacgtgtattgttttaccgggcacagtgcgccccgcctgatcgggcgtcaattggatacgcaggcatatccgattgattcataaatacgcaaaatggaggagaccatggattatcatataaaagcacccatagaaaaaaaggatgcccagtgtttaaaggcaggggattacgtttatcttacaggaaccatttatacggccagggatgccgctcacaaacggatgaaggaagctttggacagaaatgagccgcttccctttgacataaaaggaaatatgatttattatatggggccgtcacctgcaagagaaggacgtcccataggttctgccggaccgacaaccgccagccgcatggataaatatacgccccagcttcttgatatgggtatgggcggcatgatcggaaaaggaaagcgaagcaaagatgtgatagaagccatggtaagaaacggagccgtttattttgccgcggtgggaggagccggcgcccttctttccaaatgcatcgtctcatcggaggtaattgcttatgaagatcttggaaccgaggccatcagacgtctggaggtgaaggactttcctgttattgtagtaattgattgtaaggggaatgatttgtatgaaacggctattagaaattacagagaggaatcataaaaactatgaaccgtattttctatataatagtcaaaaatctttttcgcgttcctgtgtggttttaccgtatctggaagcttggccttccggaagattctcatacagatgaacagcgttatgattatatccggaatgttgtgaaaaaagtaaataaatcagggcgggtggagatttgcgtccatgggaccgaaaatcttccgtctgaaaatgggtttatcctttttccaaaccatcagggcctgttcgatgttcttgctctgatggatgcctgtcccaacccattcacggtggtggtaaagaaagaagcttccaatcttattcttgtaaagcaggtaataaaagccttgaatggattttctatagaccgccaggatatcagggcttccatggaaatcatagcaaagatggcggagggtgtaaaaaacggaaggaattatgtgatcttcccggaggggacccgtagccgtgaaggaaataaacttctggcttttaagggaggaacctttaagagtgccataaatgccaaatgtcccattgtaccggttgcactgatcgacagttttaaaccctttgacgagaagtcttccaagaagcagatcgttcaggtttgcttcttaaaacccctttatgcagaggattatcagaagctgaaaaccatgcagattgcagaaatcgtacacgacaaaatacaggaagaaataaatcgaaaaataggttgacaagtagaaatatatcttgtataattgtcaatgcgtctggaaaagattttatttgaaagaccaatcatatggaaattatgaactacggagaaatactcaagaggccgaagaggcgcccctgctaagggtgtaggtcgggcaaccggcgcgagggttcaaatccctctttctccgctcatttccaaatgattattttttactcttaggcagtgaaaaaagtagttgacatggaaatgaagatgtgatactatataccagctgtcgaaaagcagtgaaaaataaataaagaaaagtgttgacaagacagaaacgctgtgatagaataaatgagttgctgttaagacaaaaacaacacaaagcactttgaaaacagaagattgaacagtatgtaaaaccctgaaaattctaataaaataagccattgtttgatggctttgaatgagaaaattcagaacgaatacaagtaattgtatacgaaccaaacaacaagtaaaacgggaaaaaaattagctagttagttgattttgaccccggattgaaccgaatggcaggtctaagcggtatgctcatgaagctttgcttcattcgctaccatttgcttcgcaaatgttcgttgatttcccctaaacccttatggaagtaaacttccaacgggcttttgtgcaaatcaccgaccgctttcaaagactatctgcttaaatttgagagttcgatcctggctcaggatgaacgctggcggcgtgcttaacacatgcaagtcgagcgaagcgatttaaatgaagttttcggatggaatttaaattgactgagcggcggacgggtgagtaacgcgtgggtaacctgcctcatacaggggataacagttggaaacgactgctaataccgcataagcacacagtgccgcatggtacggtgtgaaaaactccggtggtatgagatggacccgcgtctgattaggtagttggtgaggtaacggcccaccaagccgacgatcagtagccgacctgagagggtgaccggccacattgggactgagacacggcccaaactcctacgggaggcagcagtggggaatattggacaatgggggaaaccctgatccagcgacgccgcgtgagtgaagaagtgtttcggcatgtaaagctctatcagcagggaagaaaatgacggtacctgactaagaagccccggctaactacgtgccagcagccgcggtaatacgtagggggcaagcgttatccggatttactgggtgtaaagggagcgtagacggcgatgcaagtctggagtgaaagcccggggctcaaccccgggactgctttggaaactgtgttgctggagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgttggggagcaaagctcttcggtgccgccgctaacgcaataagtattccacctggggagtacgttcgcaagaatgaaactcaaaggaattgacggggacccgcacaagcggtggagcatgtggtttaattcgaagcaacgcgaagaaccttaccaagtcttgacatcggaatgaccggtccgtaacggggccttcccttcggggcattccagacaggtggtgcatggttgtcgtcagctcgtgtcgtgagatgttgggttaagtcccgcaacgagcgcaacccttatccttagtagccagcaagtcaagttgggcactctggggagactgccagggataacctggaggaaggtggggatgacgtcaaatcatcatgccccttatgatttgggctacacacgtgctacaatggcgtaaacaaagggaagcaaaggagtgatcggagcaaaccccaaaaataacgtctcagttcggattgtagtctgcaactcgactacatgaagctggaatcgctagtaatcgcggatcagaatgccgcggtgaatacgttcccgggtcttgtacacaccgcccgtcacaccatgggagttggtaacgcccgaagtcagtgacccaaccgcaaggagggagctgccgaaggcgggactgataactggggtgaagtcgtaacaaggtagccgtatcggaaggtgcggctggatcacctcctttctaaggaagaagaagtaagggttttatatactgttgagtctttggttttcaaaagaagtaaaaaagaataaaaggaaacactaagaaagacaaaaatttctggtgccgatgcgcttaggggagacacccgttcccatcccgaacacgatggttaagacttaagcggccgatggtactatgctggagacggcatgggagagcaggtgggtgccagattcctttaaaaaaatcacttgaaagagtgttttatatagaacggacacgttccaatgggcggagggaaaagcgaagcctgtgttaaagaatgtgttaacctgattcagcagggcagtgctgttttatatagctggtttttaccagtgatccgtgagtttgagttgatcaagctttcgaatgactgataaacttcagtcacagtgatgcggttacgaaggtgcacttcgaaaagctgacgcttttctcagtcacggcgttccacgcctatacaatcacataaaaaactgcttatgaacacaagtgttcaacacagttttccatatgattgtgcacgcttctggttacatcgcgcatgtaccttgaaaaccacatattgaaatatatctagatagagtttttatacgtcaaagtataaagacgacatcaagacatccgaggtgttacatcgtaagatgtaaccaaacaaaactcgttaaagtaaccgtaacgtacggtgaaataacaaacctaagaccagagatacaacgctatgtatcttagatgagtcacccgcacccgcaggtgaacatcgaattggttaagctaataagagcgcagggtggatgccttggcactaagagccgatgaaagacgtgataagctgcgaaaagcttcggggaggagcaaatatcctttgatccggagatatctgaatggggaaacccagctgagcaaacctcagttgtcgtatggtgaatccatagccatacgtcgggaacccggggaactgaaacatctaagtacccggaggaaaagaaagaaaactcgatttccaaagtagcggcgagcgaaatggaaagagcctaaaccggtatgcgtgcataccggggttacggactgcaataagtgagacgatttgttaccagaacggtcctggaaagaccggccatagaaagtgaaagccttgtatgggaaagcaatagtcagcggcaggatccaaagtaccacgagacacgagaaaccttgtgggaattcgggggaccaccccccaaggctaaatactacttagtgaccgatagcgcatagtactgtgaaggaaaggtgaaaaggaccccgggaggggagtgaaaccctgaaaccctgtgtttacaagctgtggaaccacattttaagtggaaccgcgtactttttgtagaacggtccggcgagttaccgttactggcaaggttaagcacttaaggtgcggagccgaagggaaaccaagtcttaatagggcgaatgagtcagtaaaggtagacccgaaaccgggtgatctacccatgtccaggttgaagtttccgtaaaaggaaatggaggaccgaacgcacatccgttgaaaagggtggcgatgaggtgtgggtaggggagaaattccaatcgaacccggagatagctggttctcctcgaaatagctttagggctagcctcgtattagtctgccggaggtagagcactgaatttcctagggggcgtcaaagcttaccaaagaatatcaaactccgaatgccggtcagatgatgtacgggagtcagactgcacgagataagttgggcagtcaaaagggaaagagcccagaccaccagctaaggtcccaaagtgcgtgttaagtggaaaaggatgtgggatttcagagacaactaggatgttggcttagaagcagccacacattcaaagagtgcgtaatagctcactagtcgagaggtcctgcgccgaaaatgtccggggctaaaacacgacaccgaagctgtggaatgtgtattcatacacattggtagaggagcattcttaacgcacagaagcattaccgtaaggagatgtggagtgttaagaagagagaatgccggaatgagtagcgagatggaggtgagaatcctccaggccgaatatctaaggtttccagagtaaagctgatctgctctgggtaagtcggggcctaaggcgaggtcgaaagacgtagtcgatggacaacaggttgaaattcctgtaccgcatatcatcagaactgtggggacacagaaccgaggaagaacccgggaatgaaaagaccggggcaagcattttactggctgagatggaaaatccgctcagcaacaggaaggtgtgacgcgtaccgaacacaagtagggaagtcttcgtaggggctgtcaagaaaagccgctattgtgtgatatgtgcccgtaccgtaaaccgacacaggtggatgaggagagaatcctaaggccggcgggagaagcattgttaaggaactcggcaaaatgaccccgtaacttcgggataaggggtgcctgagaaatcaggccgcagagaataggctcaagcaactgtttagcaaaaacacaggtctatgcaaaaccgaaaggtgaggtatatgggctgacgcctgcccggtgctggaaggttacgaggaggggttagcggcaacgcgaagctctgaatttaagccccagtaaacggcggccgtaactataacggtcctaaggtagcgaaattccttgtcgggtaagttccgacccgcacgaaaggcgtaatgatttgagcgctgtctcgacaatgcacccggtgaaattgaagtaccagtgaagatgctggttacctgcgccaggacggaaagaccccatggagctttactccagcttgatactgggattcggtactgcatgtacaggataggtgggaggcagtgaagataggacgccagtcttatcagagccgatgttgggataccacccttgcggtattgggtttctaacctgcagccatgacctggctggggacaatgtcaggcggggagtttgactggggcggtcgcctccgaaagggtatcggaggcgctcaaaggttccctcagaatggacggaaaccattcgaagagtgcaaaggcataagggagcttgactgcgacaccgacgggtggagcaggtaggaaactaggacttagtgatccggtggtataaagtgggattgccatcgctcaacggataaaagctaccctgggataacaggcttatcactcccaagagttcacatcgacggagtggtttggcacctcgatgtcggctcatcgcatcctggggctgtagtaggtcccaagggttgggctgttcgcccattaaagcggtacgcgagctgggttcagaacgtcgtgagacagttcggtccctatccggcgtgggcgtaggatatttgagaggagctgtccttagtacgagaggaccgggatggactgacctctggtgtatctgttggtgatcaacaccatggcagagtagccaagtcgggaagggataaacgctgaaggcatctaagcgtgaagccccctcaagatgagatatcccatcgcaagagtaagaccccttgaagacgacgaggtagatagggcagaggtggaagcatggcaacatgtgtagctgactgtcactaataggtcgagggcttaaccaggttggtttaggtaagaggaaaaaaaacggatgaaaatagatatgtaacaatgtgtggttttgagggtatatgcaatagccttcaataagttttggcctggtggctcagttggttagagcgccgccctgtcacggcggaggtcgtgggttcgagtcccatccgggtcgtttaaaactaaattttgatcatgggatcttagctcagctgggagagcatctgccttacaagcagagggtcataggttcgagccctataggtcccattcggtatgcaaagcaacacgcatgagaagatttgtgccgatgtggctcaattggcagagcagctgatttgtaatcagcaggttatcggttcgagtccgatcatcggcttgcatcactttaataaaatatggatgggttcccgagtggccaaagggggcagactgtaaatctgttgcgacacgcttcgatggttcgaatccatctccatccatttggtgattaaaatcttaatcactgcatataatataattaaataacgcggggtggagcagtctggaagctcgtcgggctcataacccgaaggtcgcaggttcaaatcctgcccccgcaattttttttgagtaattttaggaaaatgtgtacgaatgaaagtacataggcccagatagctcagttggtagagcagaggactgaaaatcctcgtgtcgctggttcgattccggctttgggcatatgggatactagctcaggtggtagagcacttgacttttaatcaagttgtccggggttcgagtccccggtgtctcaggacaagccttgaaacagagatgtttcaaggctttttgttttatagaaaattttgcagatatagagatttatgaaggtagagttactcatcaaaatgggatcattcatcaaattctacaattacataataaccacgatcattgtgcttgatctctttgacaattccatgatcggatttgatacgatcccttcccatgtagcagccggacatggccacagcagggtctatgatatagctgtagctgctggttccttcccgttctatgatctgaacgtcatctccggcttttaccaggccagggcgttccattttaaattcaattaatctcatgataaccatctccttttttctttccgaagttatattatagcgctgtgagaaaaaattgtaaagagaggataaggatgctatactaaaggggtcgaattataaagaagaatggaaaaagagcagggaaatgggccagtggtttatggaggcagaaggcggttcatactatgaatgatacacctgatttattaaagaaactaaaggaatatgggaaatcggatttttatccctttcatatgccgggtcataaaaggcagtataaagaatcttttgcggctgattttccaaatcctttttccttagatattacggaaatagaaggttttgataatttacaccatccggaaggtattttaaaggagtctatggaatgggcttcagggatttatgggagcagcaggacatattatctgatcaatgggagcagcagcggaatactcagcgccataagcggaactgtatcaaggggcggaaccattcttatgagcaggaattgccataagtcagcatttcatggagttttcctcaatcagttgaaagtggaatatatttatccacaaatcataccggaattcggtattcaaggtggattaattccaggaaaaatagaagaaatgttgatgaaccatcgtgaaattcaggctgtatttgtagtatccccaacctatgatggaattgtatctgatgttaaagctattgcagagatcgttcataggtttcacctgcctcttattgtggatgaagctcatggagcgcatttttcctttgggcgagagggaaaatttccggtttccgcattagagcttggagcggatgtggtaattcaaagccttcataagactcttccttcctttactcagacggctgttatgcatgtcagggaaggatatgtggatatggggagattagaccgctatgtgcatatatatcaaaccagcagcccttcctacgtgctgatggcggggatcgagagctgtatacggtatatggccggggaaggggtgaagcagatgaagctcttctccgataaaatagattggatccgaatggttttgtctggcttgaatcatctgaaacttcttacggatcaggagaaggggatgcatggaatctatgacatggaccgctccaagatcatcatttccacaaggggtacgggaaaatcgggtacctggctggatgacaggttgagaaaagaatatcatctggaaatggaaatgtgcggtccagactatgtgactgccataacgactctggctgatacccaggaaggtcttgaacggctatgcaatgcccttctttctattgattctatgctttccacggaggctggttatgaaggtggtgagatcggcttatgtcaggagctggatagaacaccggaatgtcgtctgaccattgctcaggctatggatgaacccaggcacagaatcgctattccccacggagaaggaatgatatcggcggaatttgtttacgtgtacccgccaggaattcctatcgttgtaccaggggaggttttaaataaaacatctattgacctgatcatgaagtataaggaactggggcttgcggtgcagggtatggaggatgaggattccagagaactttatgtggttgatgaagtatgagtggttggaaagaaaaataaagacaaaattaaggataagataaaggtaagtcaaaagataaaataaaagataagataaaaggtaagtcaaaagataaaataaaagataagataaaaggtaagtcaaaagataagataaaaggtaagtcaaaagataagataaaaggtaagtcaaaagataagataaaagataaggcaaaagatgagataaaagataaaaagagatacaggataaaataaaagatagaataaaagatggagcagaaaaaatgggcaaaatattctatgtaatgggaaagagcgcttccggaaaggattcgatttataaaagacttttaaagaggcttcctcaattaaagagagttgttttatataccaccagaccgatccgggatggagaacgggatggggtggaatatcattttactaccatggataaactggaggaattcaggaaagaaaacaggcttattgaggagaggacgtatgaaaccatttatgggccgtggagttattttactgttgatgacggtcagattaatttagaagagaaaaatgggtatttaatgatcggaactttggaatcttatgaaaagaccagggattactttggaaaggacaggctgtttcctatttatgttgaggttgatgacgggaccggcttttgagagcaatcagacgggaaaggggacagaagacaccaaaatataaggagctttgcagaaggtttctggccgatgaagaggactttaaagaagagaatctggttcgatgcggaatacataggcggttctgcaatcaggagctggaaacgtgcctggatgagatcgtaaaagctgtgactgctgagatataaatgattaaaataagcatgaaagggatatgggattccatagcgactttcatgcttattttaaagttgatttttatttagcggcaagccgtttggcctttgcttccatacgggttcttgttacgtcgataaatacggcggcgattattacaaggccgataacaacgtactgtacggagcttgaagtatttaagagtgttaaaccatttcgaatggtagagatcatcagggcgccgatcagggttccccagatggttccttttccacccataaaggaggcaccgccaatgatacatgccgcaatggcatcggtatcatatggtgagatagctgcggaaggattggctactgcggagcgccctacaataaccagaccggcaatggcgcacataaatccggataagctgtaaacaaatatcagtacattatcggaattgattccggaaaggcgggcagcttccggattgccgcctacacagtaaatcattcttccaagagcagttttatttaagaagaaatgataaaccacatagatcaatatcaaaataataaagcataatggaatcccggagaatccgccggacaccttaaataagttgctggaacctaaaaatgtaacggcagccggaaagtcggaaattgtttttgttgaaaccaccagcagtgcaagtccgcagagcacatttttcataccaagggttgaaacgaacggatggggaaggtgcatttttgtgagcagtatgccatttaagaagcccacgcaaacaccggttatgatgcagaccaggatcaataccaaagagtttgtaatgccaaaggagtttttcagcatacccatcatgcatgcgcacagaattgcattggcgcctacagataagtcgatgcctgctgtaatcagcaccaccagcatggctgcggaaatcagcccgttaacagctgtttgccttagaatattcatcatattattgagcgtaaaaaatttatctgttgccaaagataaaacaatgaataaaagaaccaaggccagcaatggagccacctttcctaaaatatcttttaacttcttttttttcatcaaattttacctccccaagctgctttcatgataatttcctgattcagtacatctgtttttttcgaaagttctcccatgactcttccttccctcatgatgatcacccggtcactcattcctatgatctccggtaattcggaagaaatcatgataacacattttccggcaagaaccaaacggttcatgatgttgtacacttccactttggcacctacatcaattcctcttgttggctcgtcaaatataaagatatccgcgtctgtattgatccattttccgatgaccactttttgttgattgccgcctgataactgccccactacctcatcggcagtgggagtttttatttttaagtcactgatggtttcttccgccagctgatcgatctgtttctcatcaaagaacaggcccttcacacagtttctcatattgcttaagatcaggttcgtccggactgattgggaaagaaccagtccctggcctttgcggtcttctgttaaaaatgccattccgcagcggatgccgtctttgggtgattttatggttacctttttttcgtttacataaatttccccgctgtcataggggtcagcgccgaacacggcgcggaatgtttcagttctgccggctcctactaagcctgcaaaaccaaggatttctccatggtttgcatgaaagcttacatcccgtaaaacacctgcggagtttaaatgttctacccgaagtgcttccgtgccggtttctgattctactttcgggtattgattatccaatgttctgcctaccattgcggagattaaagaatcgttatccaattcatccgtattttttgtcaggatgtgttctccgtctctcatgaccgttacccggtcgcatagctcgaaaagctcttccagcttatgggatacgaacaaaatcgcaatgcctttttcctttaaggagcggactgttttcattaactgttccacttccttttccccaaggcttgaggtaggttcatccatgataataagttttgcatcgatcagaactgcttttgcgatttccaccatctgctggattcccatgccataggaaccgcattccttttttacatcaatatcctgaccgagagaaagcattacttcatgggccatctcatgcatttttgtatattccagaaacgggctgcctttcttttttaaggctttgttaataaaaatattgtctgtgactgaaagtagctttacaatgtttaattcctgatatacacaggcaattccggcagcggcagcatcattgggattcttaaatgaaactttgttaccttctataaaaatggtgccttcttccggaatatgtacgccggtcagaaccttgatcagggtggattttcctgcaccgttttcaccgatcagtccgtggatctcgccgggtctgatctgcaaggacatgttccgcattgctactacaccggggaagcgttttgtcacacctttcagctcaaccaaataattactcataatgccgccaaacctttccttacgtgctcaagttgattattttaagtagcctttcagtttttctaagtatgtttctgcattttctgctgtgatgacttcacatcccgtatctacgaaggtttcaacggtttccccttttacagcctgaagggctgtttcaactgccttgtagcccatggtataagcggcctgtgcgcaggtagcggttatgttgccgtcaatgatattctgaacaccgctttggtttccgtcaaagccgacaatgatgacatcctttaaaccaagctgctttacggcattggatgcgccggctgctgtatcatcgttgtggcagcagacgatctgaatgtccccgttctgagcggtaatgatattttccattacatttgcagcagtatccggattggactgggcatactgtacggaaacaatttcaacgccgttttcttccagagccttggtatatcctgcctggcgggcatcgctggtggcattgccttcaacgcctccgataataacagcttttgcgccttttccggcttttttagcggcaaatgtaccgccttggtatgctgcattgtcgttaccggttcccacaaaggagacttttcctgctatttccgcatccgtgtctacggttatgatgggtatattcacatccccgattacgcttgccacggagtcagactgcagaggagagatgacaaatgcatcaactccgccggagagcatggtttcaatcatattgttctgttcatcataagctgtttcagaagcaggaccctgtaaatcaaccttaacccccagatcttttgaggctgcctggacacctgccgcaacataaccccagtattcgctggacagtgtttttaaaatgacacctatggtgacattctcagaagcagccttttctgctgtactggattctgaaacagtcttttggtccccgcagccagtcatggaagccagcattgcagatgctaacagcatggataaaatttttcttttcattactttttaatctcccttcttaactttctatcgttttgatagtatgaatgaatgctatgtatttgttattttaacagtgaaaggggaggggacaatggtatattttgtgcaatatgggggtgtatttttcgaaactagtctataaataagaaaaaaagccttattaaacaggataataagacttttttatggtttaattatacaaaaaatgtgaaaagagttaatcgatagcaatggttccgttgtgaaaggtgatattcttgccttccattgtgtaagcctctgcaatctggtttgtgataattatcacagcgatccctgactttaagacttccttcagcagattgatggtaatctggcgcatttgaaaatcaacagatgaaaaaggttttatgcataccaggacctttggccggacaaagatccagcgatagtacagaagctttagtttgcattcttcactgatcatatatgtttttttcatcaattcttcttctgtaaatattccttccatcagatgccaggtcatctttttgtatttttttcttaaaaggtattttttcttttttcgctggatcataaaagtcatatgatccagaacggtcatatcggcaaacagcatttcttccattggcctagcttcaataaaggcgatgccatcccgaatggattggtgaacagactggaaggagtattcacttccgcctaataaaatttttccggcttcaaatccacattctccctgaaggatgggaaggatatttctgcattccgtagaatctaagtctaatatgtttaaaacatctcctgcacttaatgagagattcaatacagggaggtcaggcagcttcacatcccggaattctaaaaccgtttttttatcaatctgtttttgtgccagattatttttttttaaggtgttttttttggtcttttcaaacagttccatataagtctggaatttggaaaaattctcctgattcatatggccgatggtcctgccgtttttgatgatggttatttcatctgcatgttcgtataatttggtggagctgttaacaatgaaaaggaaagtcattccccgggcctttaactttttcacaagaataaagaaatttttgagctgctcttccgtcatgatcatttccatatccgttatgacggccagatgacacccggagacataagcgcgcattaattctgcctgtttctgcatgccgggatccagcaggtgagccttatccagaaggggaatggaactatccagatcatcaagaagaccgggagcttgccggcagagaggattcacccgcttccagaatgagaccctgccgctggccacgaaaatgttctcagccacgcttaaggcagaaaagatccctttgttgcggccgataaatgcaatctgtttctgcatctgctcctgcattttgggagatgttattttctttcctttataataggtccagccatagcctggtgttaaatttccgtacagtagctgcaggaaatattctttttcaatggcattattaacgatgacacagcagatttctccttcaaaagcccgaaaatagagtccgttaaaacaggtctggccctccatggaacagtggatattttcatagcggatcagttcagttttcatgattttctcccttcttgcggctcaaacatataaggaaggatgaggcatacttccgttccgattccgggagtactgaggatgtggaggccatattcgtcacccatgagaaggcggattcttgagttcacatttatgagggcgattcctccctttcctccttcattggcggagccgtctccggcatccattcgggaaagcttttcattaaggcttccaagcctggcttcttcaatgccaatgccgtcatcaatcacggaaaggtaaaggatggtgtcgctgtgttctatgtcgatgacaacagtcccccctgaaaccttgggttccaatccatgtttaatggcattttccacgattggctgaagggtgagcttggggattctggtttttaaaatttcatcatcatcccgtggcagcttgatctttaattccagcttatcatcaaagcggtatttctgaattaaaaaatagttctctacattggccagttcttcctgaagggtgctcagcctctccattttagaagttgtatagcggaagaatacggcaagggcttctgtgatctttccgatttccgggacgcccgccataagcgcatcggaacgtatggattccagtacattatagagaaaatgaggattgatctgattttgaagagctaaatatctggcttgctgcttggcgttttccattattttatctttatccaggatggtatccacctttaaaagcagggcatctgtgtcaggcgaaattccttccaggcttttgaatatttctgtgaaaatgatcccgtcattaaaaagctctactttttttttcatggttcccaggggctctaagatcctgatcctgccaataaccagcagcaggagaaaggaaagcagcatactccataccataattccatatagaatggattccgtcagttccggcttcagcagaatcaaaaaaaacagaatcagggcaagacagctccaagagatcatggccctgatccagatcagaattcgttttttcaaccattgttttttcaaaggacatcctccccgtttcagcgttccagaaacattttgcggtattcattaggagagacacccagcgtttttttaaactgtttggtaaaaaatttgatatcgctgtagcctaccagttccgctatttcactcacattccgttctttttctaccagaagctttttggcggtctcaattcttaccatctgtatatattcagtgagtgttttccctgtctcttttttaaatagatatgaaaagtaggaatagctgaatcccgcatttttggccagctcttccagctttatatcaatgcccttgtttttttctatataatgtttggcataggcaaccggttttatttccctgctttttaaatggttcagaacttcaagtaaggttttaataatggtttcttccaggagttcaaatgcctggtcaaggttgatacaatgctcatacatttcagaaaagtaagcagcttttccgcttttgtccagagatgtgtcaagcagctcgaaccagtccatataattgtgggccagccgaagcagctccgtcttaacatcaaggccggatatattttttgtttcgtgcatgatccgtttggcatcatttaagcacttttttatttcttccggttcaaaggattccggcctgttttctaacagacttgaaatctttgaagttaaggtgtgattctcttctgattcagcagcaggtgcatttaattctgagaccgtattggtatcagtaaggagccggttgtacatggcgatccggctgtgctgtatctgccggatcagatcctcatctgaatctaccggctctgtaatgattgccgtaaaatatagctttggaaataagtcctgaagtcccatgacccggtctttcacatggtttaaggctttgatcagttcttccttgtcatgaggttcatggcagagcaacaaaaatatgccctcttccgaggactcaatggttaattctccttcatcagaagcaaattccacctgcaggatctcaatggttttatcaattaaaagctcataggcatcttttgtaaaatccttatattcaatgtccggctttacaatcaggcagcggccggtctggtctataacctgggaggtattgattttccggacttcttttaatactttctcaggcctttgctccggtttttgttccagtactatttttaaaaatacccgtttaaactcaccggaatagtttttgatggttttctctaaatgaatacgggcttcctggctgtttttctgctccatggtttcattaacaagcttttttaacgtgcgggttaaatcatcctgattaatgggttttaataaatagtcccgtactccgtatctgatcccctgttgtgcatattgaaagtccttatagccgcttatgattatgcacttaagggaagcattctgttttttggcctcttcaatcagctggagaccatccatgcccggcattctgatatccgtaagcagaacgtcaggtttcttttcctgaatcagctgaaaggcagataaaccgtcataagcaacacccagaagcttagccccaatttcatcccagtcgatcagatattccaaaagcctgcatatctttttttcgtcgtctgcaattattattcctaaaattaaaatcatcccctattgttttaattttgatacaaatgataccttctcttttcagtatacttcaccgggtctataatctcaactcaaaaagtttcaagcgctgcaaaatattggcagaaagtgtgcagaataaagagaaatgataaaggtttgccaatacttctttcttgtgatgataaaagttctatgctataattagttaaattcgtttttacgtctttacagacaggaaagacggatcagacaacagcgacagggggtgcctctatgccagggtttaaggatatcatcggccatgagagaattaaagaacatttgcaaaaggccattgaatcaaatcatgtttcccatgcgtacattcttacaggtgaagcagggatggggcgtaagtccctggccaatgcatttgcaatgaccctgctctgtgaaaagggaaaaagtgagccatgtatgcagtgccatgcctgcaagcaggtcatgagcggaaaccatccggatctgatttatctgacccatgaaaaaacgggaagcattggcgttgacgatatcagagatcagattcatgacaccatcatgatacgcccttacagcagttactataagatctacattgtggatgaagcggagaagatgacggtccaggcacagaatgcactgttaaagacaatagaggaaccgccgtcttatgcgatcatcatgctgcttaccaccaatcaggaatcatttctgcccaccattctttccagatgcatacagttaaagctgaaaccattgcaggatacggtggtgaaatcctatttaacaggatctttgggcattggagagagcaaggcggaggtttatgcggcgtttgccagaggaaatctaggaagggcgattcatttggcttcctctgaggagtttcagctgatgtatacggagttgctccatatgctgaagcatataaaggatatggatattgtggagctgcttttttacattaagcggatgaaggatgaaaagctggatatttacgactgccttgattttatgcagctgtggtaccgggatgttttaatgtataaggtgactcaggatatcaatcttctggttttcagggaagaatataatacaatgaaagagatgagcgctgccagcgcttatgacggcattgagatgatattacaggccattgacaaggccaggatccgtctggatgccaatgtgaatatggagttggctatggagctcatgctgcttgtaatgaaggagaattaatagatgataaaagtaataggcgttcgtttccgcaatgcagggaaaatatattactttgatcccatgagcctggaggttcatacaggggatcacgtaattgtggaaactgcacggggaattgaatatggttacgttgtcctggggtgccgggaagtggaagatgataaggttgttcagcccttaaagcctgtgatccgcatggctaccaagggtgatgatgaagtagaaaagaaaaatcatgagaaggaaaaggaagcatttaagatctgcaaggagaagatcagaaagcacggtcttcagatgaagctgattgatgcggaatatacctttgataacaataaggtgttgttttattttactgcggacggaagaattgatttcagggagcttgtgaaggatctggcttctgttttcaaaaccaggatcgagctccgccaggtgggagtccgggatgagacgaaaatcgtgggagggatcggcatctgcggaaggaccttatgctgccattcttacctttctgaattcatacctgtgtccattaagatggcaaaggagcaaaacctttccttaaatcccacgaaaatatccggggtttgcggaaggctcatgtgctgcttaaagaatgaagaggaaacttatgaagaacttaacagcaagcttcccaatgtaggtgattttgtgacaacagatgacggactgaaaggagaggttcattccgtaagcgtgttaaggcagctggtaaaggttgttgtcaccattaaggatgaaaaggaaatccgggaatataaggtggaacagctgaaattcaaaccaaggcgccgccgggaaaaggcccaggtgactgatgcagagttaaaggcattggaagcccttgaaaaaagagaaggaaagtccaagttagatgacaattgatttaaaggaaaatgaacgtattgatgatctgcagagaaatgggtataagatcattcagaaccgggatgggttctgctttggcatggatgcggtccttctttccggatttgccctggtaaagccgggggaaaaggcggtggacttagggacaggcactggaatcattcccattctgctggaggctaaaaatcagggccttcattataccggtctggagattcaggaggagatggcggaaatggccagaagaagcgtggccttaaaccatctgcaagaaaaaatttccattgtgacaggagatataaaggaagccagccgtttatttggcggggcttcctttgacgtagtgacctcaaatcctccgtatatgaatgattcccatggccttaaaaacccggaactgccaaaggccattgcccgccatgaggtgttatgcacccttaatgatgtgacaagggaggcggcaaggcttctgcgcccgggagggcggttttatatggtgcaccggcctcaccgtttagctgagatcataacggctttaaaagactgccggctggagccaaagcggatgaaaatggttcatccctttgtggacaaggaggcgaacatggttttaatagaagcggtgcggggaggaagatccatgatcaaggtggaggcccctgtgattgtatataaagagccgggtgtgtatacggatgagatttatactatttatggatattaaattttgctgggagcaggaacattggaagagaaaacgggaaagttatttttgtgtgcaacgcctatagggaatcttgacgatattaccttaagggttttaaacacgttaaaggaagtggatctgatcgctgcggaggatacccgccacagcattaagcttttaaatcattttgagatcaaaacacctatgaccagttatcatgagtataataaggtggaaaaggccagatacctggtggaacagatgaagcagggggtgaggatcgccctgatcacggatgccggaactcctggcatctcagatcctggagaggaactggtaaagcagtgctatgaggcaggaattgagctgacttctcttcccggtccggcggcttgtattacggctctgaccctttccggacttggtaccaggcgtttctgtttcgaagcctttttaccttctgataagaaggaaaagcagtggatcctggaagagcttaaggaagaatccaggaccatagtcatttacgaggcgcctcaccggcttgtcaaaaccttaaaggagctttatgaggctttgggtgaccggagaatcaccatttgcagggagcttacaaaacggtttgaaacagcgtttcgtacaacctttttcaatgctttaaagacctatgaggctgaagatcctaagggagagtgtgtcatcgtcatcgaaggaaagagcatcagggagaagatagaggaaaaatccatggcctcccgggagatgtccatggaggaacacatggaactttatgtaaaccaggggctggacaggaaggaagctatgcgcatggttgcaaaggacaggggaatcagtaaacgggaggtttatcagtatttcataaaaaatgaatgagaaaatttctcttgacaatccgcgtttctttttataaaattactttgatattcaaaatatttgataaataaaacaatccaacgcggcatggatcccgtaatcctaaaggggagaggggacatggatgggggaatttaatttatgacaacaagaataataggaacaggatctgctgtcccggagcaggtggtaaccaatgaagatctggcaaaatttgtggataccagtgatgaatggataaggaccaggaccggaataagggagaggcggatcgcatcggcggagtcgggaacttctgacctggccattcaggcggcagaagaagcgcttaaaaatgccggtgtttcggcaaaagagctggatatcatcattttagccacgtcttctgcggattgctgtttccccagcggcgcctgtgaggtacaggcggccatcggagctgaccatgcggctgcatttgatatcagcgcggcctgctccggatttgtttatgctttaaatacggtccacagcttttttaaagcagggatctatcagacagggcttgtgatcggagcggatacattaagtaagctcattgactggaatgacagaagcacctgcgtcttgttcggtgacggggccggagcagctgtggtacgggcggaagaaaagggaatccttcacatgaccatgggagcggacggaaccagaggaaaggccctggaatgcggagggcggactacgggaaatttcctcacaggaaaaaagccggagcttggatacatgaccatggacggccaggaagtgttcaaattcgcagccaaaacggtgcccgaatccattagaagggtagtggaagagagcgggaccgaaatggaagaaattaaatattttatcttgcatcaggcaaattaccggatttttgaatccatcgcaaaaaggttgaagatacccatggagaaattccccaccaatctggaacggtatgggaatacatcgggggcgaccattcccatacttttggatgagatgaaccgggaaggaaaattacagcggggagataagcttgtacttgctggctttggggcaggattgacctggggagccactcttttggagtggtaatgattttgactaatactttgaaactcaaagtaatagcataaaattaaatataaatgaaaatgaaagaggagattaaaattatgttggagaaaatgcaggaaattattgcggagcagttaaacgtggaggcaggtacaatcactgctgaatcctccttcaaagaggacttgggagcagattctttggatttgtttgagcttgttatggcacttgaagatgagtactctgtggagatcccgtctgaggacttagagaaactgaccacagttcagcaggttatggactatttaaaagcaaagggcgtggaagcgtaatgaaaaccagaattaccgaacttttgggagtggaacatccgattatccagggaggcatggcctgggttgctgagcatcatctggcggcggccgtatcggaagccggaggccttgggctgatcggcggggcaaatgctccggcgaggtggtacgggcggagatccgcaaggcaaaggaactgacgggaaaacccatcggcgtcaatgtcatgctgttaagtcctcatgcagaggatgtggcaaaggtggtagtggaagaaggcattaaggtggtgaccaccggagccggaaacccggaaaagtatatggatatgtggaaggcagcaggcattaaggtaattccggtggtggcttccgttgctctggcaaagaggatggaaaaatacggcgcggacgcagtggtggcggaaggcagtgagtcaggcggacatatcggcgagcagaccaccatgacgttagttccgcagatcgtggatgcagtatccatcccggtgattgcagccggcggcattggagacggacggggaattgcggcagcattcatgctgggagcagaggctgtccagatcgggaccaggtttgtggttgcaaaggaatccattgtccatgacaactacaagcagcggatcattaaggcaaaggacattgattccgctgtaacagggcgcagccacggccatccggtcagatccttaagaaaccagatgaccagagactatgcaagactggaacaggaaggcaagtcttttgaggaattggagtacatgactcttggaaccttgagaaaggctgtccaggagggggatatcacaaacggcacggttatggccggacagattgcaggtatgattttcaaagaacagacctgcaaggaaatgattgatgagatgatagagcaggctgagaaattgcttggccgataaagaggagtttattattatgagcaagattgcatttattttcccaggccagggtgcgcagtactgtggtatgggccaggatttttatgagcagacaaggattggaaaagaaacatatgatatggcttcggacctgcttggtttttccctaccggaactttgctttgaaaagaatgaccggctggatattacagaatatacccaggcagctatggtaaccaccagcatcgccatgatgcgggtgctggaagctgaaaaagggataaggccgcaggtgtctgccggcttaagcctgggagaatattgtgcgcttgcagccgcaggcgtcatgagcgataaggatgccatacgcacagtcaggcagaggggaatcctcatgcaggaggctgttcctgcggggctgggagccatggcggccattctggcactggatgccttaaaaattgaagaggtattaagcggtatggagggagtccagatcgccaattacaactgcccagggcagattgttatatcaggaaaaaaagaagctgtggaagctgctaatgaaaagcttctggcagcaggcgcaaaacgggcgctgatgttgaatgtaagcgggcctttccattccaccatgctcaaaggtgcgggggaaaagctgggagaggtgttagagggtgtggaaataaaaacccctgaaatcccttatgctgctaatgtaactgcccggtatgtgacggacagtgagatggtaaagcctttgcttaaggagcaggtgtattcttccgtgcgatggcagcagagcgtggaaactatgctggctgacggggtggatacctttattgaaatcggtccgggcaagactttagccggatttatcaagaagattacgaaagacgtaagagtctttaacatagagaagctggaagacatggaggcacatttttcttagggcgttcctgataaaagaaagggtaagcgcagcttgaattttaccctaaagggcacttagaaaaatagccgttcgatgaaccgtaaggtgaatggaacttcattatgaatgcaggaggtaagaaacatgttagatggtaagatagcagtagtgaccggagcagccagaggaattggcagggcgattgccgtaaagctggcaggccagggagcaacagtggttataaattataacggttctgataccaaggcaatggaagtggtgaaggagatcgaagaaaagggcggcaaggcagaggccatccagtgcaatgtggcggattatgagagcgtgggttcctttttagagggcgtcataaagaaatacggaaagctggatattcttgtgaacaatgcgggaatcacacgggataatctgctgatgaagatgtctgaggaagattttgacgcggtgatcaataccaatttaaagggagtattcaactgcatgaagcatgtggcccgccagatgatcaagcagaagagcggaaggatcataaacatttcttcggtttccggcgtgttaggtaatgccgggcaggcaaattactgcgcagcaaaggccggtgtcatcggcattaccaagtcttttgccagggaggttgcaagcaggggaattaccgtgaatgcggtggctcccggtttcatccatactgccatgactgaggttctgtcggaatccataaaggcggcgtccttagagcagattcccatgaagcgttttggagcagcggaggatattgccggtgcggtggcatttctggcatcagaggaagccggatatatcaccggtcaggtgatcagcgtagatggcggcatggcaatgtaggaaggcatacctttatgtccaaaaagcatggacaggaaagaggaacgccttacaggcatacctttatgcccaaaaagcatgggcaggaaagaggaaaggagagacgggatgaagagaagagtcgtagtaaccggcatgggtgccattactcccattggaaaagatgtggaaagcttctggaatggattaaaagaaaaaaaggtggggatcggaccgattacccagtttgatactacagattataaggcaaagctggctgcagaggtaaaggattttgatcctaaggagtacatggatgttaaggcggcaaagagaatggagcgctttgcccagtttgctgtggcagcgtccagggaagcccttgagaactccggcattgatatagagaaggaagatccttaccgggtaggcgtaagcgttggttccggaatcggaagcctgcaggccctggagagagagaataaaaagcttttggaaaagggaccgggcagggtgaatccccttctggtacctctcatgatatccaatatggcagccggtaatgtaggaattcagtttggattaaaaggtaaatgcatcaatgtggtgactgcctgtgctaccggaacccattccattggggaagcattccgttctattcagtacggagaggcggatgtaatggtggcaggaggtgcagaagccagcatcactcctatcggcgtggctggatttacagctcttacggcacttaccacctccgatgatcctctttgtgcctccatcccatttgataaggacagaagcggctttgttatgggagaaggggccggtgtagttgtcttagaagagctggagcatgctctttccaggaatgcggtgatttacggcgaggtagttggttacgggtcaacctgtgatgcatatcacatcacttctccggcagaggatggaagcggtgcggcaagggccatgactgatgcaataaaggatgcaggtattaccccggatcagcttgattatgtcaatgcccacggaaccagcactcatcacaatgacttatttgagaccatggccatcaaaactgccctgggcgatcatgcaaagaatgtgaagatcaattccaccaagtccatggtgggccatctcttaggtgcagcaggaggcgtggagttcattgcctgtgtaaaatccattctggatggatttgttcatgcaactgccggccttcaggaagaaggagaaggctgtgatctggattataccaaaggggaaggtgttgccttggatgtaacatatgccatcagcaattccctgggatttggcggacacaatgccagcattcttgtgaagaagttcgaacaataggaggcagtctatggagatcaatgatattatcaggctgatgcaggctgtgaaagaaaatgatttaaccggctttaggatggaagagggagacttaaagctttgcattaagaaagaaaaagaaagagaaatcgtgacaatatccggaagctctgcggcacccgcagaaacggcagcaggtgttttcacccagcaggcgccttttgctgcggccagttcagggaatgtgacggaagtgccgggaaatgatatctgttccgacaaaatcgtatcctctcccctggttggaaccttttataatgccccttctccggacagtgaaccgtttgcaaaggtgggagatcaggtgaaaaaggggcaggttctgggaatcatcgaagccatgaagcttatgaatgagattgaatgtgaatacgatggtgttgtggatgcagttatggtaggcaatgaagatgtggtggagtacggtcagcctctgttccgtatccggtaagacgttgtgatagctatgagaggcccagaggctgggcctctcttttaaaaataggagggcgcatgatgttagatattaaggagattcaggaaatcattcctcacagacacccatttttgctggtggactgcattgaagagtttgaaccaggagtaaaagcggtgggatataaatgtgtgacttatgatgagcctttttttcagggacattttccggcagagccggtaatgccgggggttttaatcatagaggcccttgcccaggtcggtgcggttgccatcttaagcctggaagataacaagggaaagattgcttatttcggcggcattgacaaggcaaaattcaagcataaggtcattccgggagaaaggcttaagctggaatgtgaaatcattaagcgtaaaggcccggttggggtggggaaggccacagcaaccgtggacggcaagctggccgccagcgcggaactgacatttatgattggataggtgagcttatgtttgataagattttaattgccaaccgcggagaaattgcggtgcgtatcataagagcctgcagggaaatggggatcaaaacggttgccgtttattcggaagctgaccgggagagccttcataccttattggctgacgaggctatctgcattggtccggcaccttcgacccagagctacttaaacatggagaggatcattacggctaccgtggccatgaaggcggatgcaattcatccgggatttggttttctttcagaaaatgcaaggtttgcggaactttgtgaaaaatgtaacattgcctttatcggtccctctgcgggaatcatcgggaagatgggaaataagtccgaagccagaaagaccatgatggaagcaggagttcctgtgattccagggggaaaggaagctgtccgtcaggtgggagaggcaaagtccatggcggaaaggatcggttttcctgtgatgatcaaggcttcttccggaggcggcggaaagggtatgagaatatccagaagcttagaagattttgaggctaattttaagaatgcccagatggaatctgtaaagggattttccgatgatactatgtatattgaaaaatacattgaaaagccaaggcacattgaatttcagatcatggcggataagtttgggaatgtggtgcatttgggagagcgtgactgttccattcaaagacgccaccagaaggttctggaggaatccccctcagcagctatttctcaggagctgagagaccgaatgggagagatcgctgtccgtgcggcaaaagcagttggatatgagaatgcgggaaccattgaattccttctggataaacataagaatttttattttatggaaatgaacacccgtatccaggtagagcatccggtgacggaaatggtgaccggattggatctgatcaaggaacagatccggatcgcagcaggagagcctttgagcataagtcaggaggacgtgatgatcaaaggccacgccattgaatgcaggatcaatgcggaaaatccggcgaaaaacttcatgccctgtcccggacttataaaaaacgttcatgtgccgggaggcaatggagtccgcattgacacccacatttacaatgattataaggttccggccaattatgattccatgttaatgaagatgatcgtccacggaaaagaccgggaagaggccatcttaaagatgagaagcgctcttggggagctgatcattgagggaattgagacaaatgtggattttcagtttgatatcctgagtcatgaagcttaccgggacggagacgtggatacggattttatcccgaaatatttcccggattatgtccggtaggcaggtaaaggagcaatcttatgttaaaaagcatgtttaagaaaacctatacattaatagacagcaaatacaaggctcctgaaaagtcagaggaacccaatattcctgcgggtttatggaggaaatgtaataaatgcagccagcccgtttacggggaagatgtgaaaaacaaccattttatctgccccaaatgcaagggttatttccgcattcatgcttaccgcagaattgaaatggttgcagatgagggaacctttgaagaatgggataaggagatggaatttaaaaatcctcttgatttcccgggctatgataaaaaggttgcggcagccagggaaaagacagggcttaatgaagccattgtcacgggcagctgcgcaataaacggccagaaggcagtgatcggtgtctgtgatgcccgcttcatcatgagcagcatgggccaggtcatgggagagaagatcgcaagagctgtggaacgggctacaaaagagaagcttccggtgattctttttgcatgctccggcggagccaggatgcaggagggaatcgtgtccctgatgcagatggcaaagacctcagcagccttaaagcgccatcacgaggcaggccagctttatatcagcgttcttacggacccaaccacaggaggagtgacagccagctttgccatgctaggtgatattattctggcagagccttttgccctcatcggatttgcaggtccccgggtgatcgaacagaccattgggcagaagcttccggaagggttccagaggtcggagtttttgcttgaacatggcttcatagataagattgtgccaagggaagagatgaaggaaaccctggcagatatcttaaagctccacaatccccggaccagtcaggcattttctgtggataaccggacaaaaggggaagctatcggtggaaaaaggaaatccttccggttgagaaagaataaaagaagcgcctgggatacggtgctgttatccagaagctcggaccggccggtggcgtcggattacatccatgaactgtttgatgattttctagagtttgcaggagaccgctattataaagatgacggagccatcataggcgggatcgcctccttccatggaattcctgttacggtcatcggacaggaaaaagggaagaatacaaaggataacattaagcgcaattttggaatgccgtcacctgacggctaccggaaggccctgcgcctgatgaagcaggcggagacctttggccgtcccattgtctgttttgtggatacgccgggagccttctgcggcctggaggccgaggaaaggggccaggggaagccatagccagaaacttatttgaaatggcggatttaacggttccggttctttctatcgtcataggagaaggcggcagcggcggtgcacttgccatggcagttggcaatgaagtctggatgatggaaaattccatctactccatcctctctccggagggttttgcttccatcctttataaggacagcaaaaaggcaaatgatgcggccagggtcatgaagatcacggccagggatttaatggatttaggtctcatagagcgggtgattcaggaggaagagccggccaatggggataatctttccgcaattgcggaagaaatggataaggccatggaagaattttttgccacttaccttgccatgacaaaggaagaactagcaaatcaaagatatgaaagatttaggagaatgtaatgggaacattaaaacctttggtaataggagacctgtcagcaaagcatccggtgatccagggcggcatgggagttgggatcagcctttcctccttagccggagcagtggcaaaggccggagggatcggtattatttctacggcacagatcggctttcgggagccggattttaagcagaatcctctggaagcaaatttacgggccattggacaggaaatgaaaaaggcaagggaaatcgcgccggaaggcatcataggctttaacatcatggttgcgacgaaaaactatgccagttatgtgaaaaaggcggtaaaggccggagcggatttaatcatatcaggagccgggcttccagtcagcctgccggaatatgtggcagaggctgcagaagaagcagggatcgtgttaaagaccaagattgctcccattgtatcaacggtaaaatctgctatggtcatctgcaaactgtgggataggaaataccatcgggcgcctgatcttgtagtagtggaaggacctttggcaggaggtcacctgggattttccagagaggaactggaaaaccttggggtggatacggacgatgtggaccacacctataagcaggctgattacgatgaagaggtgagaggcatcatccggcttgtaaaagaatacggggataagtataataaggtgattcccgtggtgaccgcaggcggaatttactctcatgaagatgtcatgcaccagctttccctgggagccgacggagtccaggtggctaccaggtttgtgactactgtggaatgcgatgcgccggaagaatttaagcaggcttatcttcaggccaggaaagaagatatcgtcattaccaaaagtccggtaggaatgccgggaagggccatcatgaatccttttctaaaaggcgtgggaaataatcccttccgtttaaagcattgctaccaatgtctggaaaagtgcgacagaactacaattccttactgtataactgaggctttggtaaactctgcggaaggccggactgacgaaggtctggtgttctgcggaagcaatgcataccgggcagaacggatggaaacggtggaagaggtcataaaagatctggttggttagattttgctaaaagggactgcaaggctgcaggtttgaagaaaccggagctgcagtccttttttccggcgaaccggcagataagactgtttaacaaggtgaagtgaatcagctgtataaatttaccagaaaaagtcattttttatgttgttgcatgaaaattaagggaatgctataatgggaaagataaaaattttttagaaaactagagagaaatggagagctgtatggaaagcaagaaaatcattcaggtggaagaaaaagtgccatttaatatgttggtgcctttaagcattcagcatatgttcgcaatgttcggggcgtcagtcctggttccttttatatttggaatcaacccggcagttgtactgttcatgaatggaattggaacattattttttattttcataacaaagggaaaagcaccggcataccttggctccagttttgcattcctggcaccggcaggaattgttatcagcaaatggggctataattatgccctgggcgggttcgttgccgtgggaatcggcggatgtattctggcaataattatttataaattcggttcggactggattgatattgttcttcctccggcggctatgggaccggttgtggccctgattggcctggaactggcgggaacagcggcatccaatgcaggtctgaaggatgaaatgattgatatgaagaatgtcattgtttttctggtaactctgctgaccgcagtgcttggctctgtggtattcaagaaattcctgtccgttattcccattctgattgcgattatagtaggatatgtggcagcgcttttatgcggcattgtaaactttagtgaggtcagcaccgctgcatggctgtcccttcctaattttacagcgccaaagttcaaatgggaagcaattgtcattattcttccggtgcttctggtggttacgtcggagcatatcggtcaccagattgtaaccagtaaaatcgtggggagagatttaatcaaggatcccgggcttcaccgctccttgctgggagattatatatcaaccacactttccggacttgtgggttccgtgcctaccaccacatatggggaaaatatcggcgttatggcaatgacaaaggtatacagcatctatgtgatcggaggagcggcggtcctctccgttgtctgctcttttatcggaaagatgactacactgatcaacacaattccaggtccggtaatcggcggaatttcattcttactgtatggtatgatcggagcctcaggcattcggattctggttgatgcacaggtagattatggaaagtccagaaatatggccatgacttcagtcatttttgtaacaggcctttccggtgttgccgtaaagtttggaagtattcagctgtcaggtatggttcttgcatgtgtggtgggaatgctcatgggcctcatgttctttgtgctggataaactgaatctgacaaacgacagggacaaggcgtaactgattaaaggaaagacctgggtgtgtcaacaaccgggaaatgtaaatagaagatcggaatgaatatgataccgcaaagcaacggaatatcagctgctttgcggtattttttgttttgatgtaaatgctccctgattataattctgaagaaggaggctttattttactctgaatttgcaccagggaaaactcataaggtcatctcgggggaataagatggattaagaaggaattgaaagatattaagaagaggaaagaggaatgctgaattatttatgggcctttatgatgctggtgggagtcctttggggagcttttcatgggaatttaaacggggtgacagaaggagcgctgacctctgcaaaggaagctgttatgctgtgcattaccatgctggggatcatgtccttttggagcggaatcatggagattgggcggaaatccgggctgatcgaacggatgtcgcataaaatgggccccatactccgctttctgtttccaaagattcccagagaccatggagcgtttgaatatatttctaccaatatcatcgccaatatccttgggcttggctgggcggcaacgccggctgggcttaaggctatggaggccttaaaggagctggaagaggagaggagaaaggggaggttcctgaaagatattcggttaaaccggttcccgagggaactgcaaataatgagatgtgcacctttctcatcattaatatttcttccctgcagttaatacctgttaatatgattgcctacaggagccagtacggcagcctaaacccaatggcagtggtgggcccagcgcttattgccactcttgtgtcgaccattgtaggcgtggcggtctgcaagctgatggaccgttaggctcttcctataagattgtcttgcaataaatcccttacttatttcgagtgcgggatttatttttatgtcaggttaaaaaagcatcaatgccattgtgatttagatgatatgcacaatatttttctgagttattaagcatattggttatttacaacacttccagaatatgttaaattattatcgtaagatagataagaggtaataccttatatgataggaggtctgatatggactacgaaattgataagaaaaacctgaagcggtgcgcagaaatttcccgccagtcaagagaggcgggcaacacgccttttggtgcactccttgctggaaaagatggaagcattcttctggagcagcccaacattgagatcaccgaagggaaatgtaccggccatgcggaaacacaggtagctgagagagcatcccaattatattccaaggattttttggcagaatgtactctttataccaccgcagagccatgcgccatgtgtgcgggggctatttactgggcaggcatcggacgggtggtgtacggcatgtctgaaaaagatctgctggcccatacaggtggggatcctcaaaatcctacttttgatctgccctgccgtgaagtttttgcaaggggacagaaaaagattgaagttgtgggaccttttccagagctggtagaagagattgcagaggtccacaaggggtattggaacaattaatgaattgaatgaatcgtcaggagggtttcgagatggaacagaaaaatcagagtcaacagacggatacggagtattcccgcagtgccgtgccgttaagccagcggaaaagctatttcagtcttacgattatttggaccgggtttgtctttgttatcaccagcatgatggcaggagggggacttgcagccggtctggattttaaagggattatcattgcaaccctgggcggaaatattttcttgagcatcattgctgtgctgatcagcatcattgcctgtaagacagggcttacctttgccctcctcacccgctacagctttggttccagcggctccaaggcggcgtcgattttcgtacctatcgtaaactttggctggtataccattcaggcggctacctacggacattttgtggcccaggtattccattttggctgggtgggagaagggatctgtatggcagccagcgccattgtcatggggatctttgcaatgttcggcatacaggcaatcgctattctgggctatattgctatccctgcaatcgtattcttgtccattgcaacagccatccgctcactgggcgtcattggcggcgctgaggccctgttttcctacattccaagcggaagcatatccctgtattccggaattacggcagtaattggtacctgggtgctttccaccgctacctgcattgcagatatcatgcgctatgcaaaggatacgaaaacagccgtatccgccactcttaccggccttcttggaggcaacatcctcatgatcgtctgtggagcgattgcggccattgccatgcagaacagcgacttaactgtcattcttttaagctttggcctggttattcccagcctgatcctcatgaccacaaacatttttacaaccaatgcggcgaacctttattccacctccttaaacttatccaatgcgtttaagatggaaagaaagaagatgctggggatccttttggccctgtccgctcttgcaacccttacaaggccatatgaaatcggtttcctgttcagtttcttaaatatccttggaacagtggttcccccattgtccggcatcatactttccgactatttcctggttcacaaaggcaattacctggaatatgacaaggcttccttccggaaatggactcccattccctgggtcacctggggtgtctgcatcgcagcagtatacataattccctttggacttccgtcactgaacggtattattctgggagctgtcatttacacggcattgatggccgtgaccagcaggcaggcggcaggaaaactggctgaagaagcgtaaaaggagggattgatatggacagatataaattaagcgccctggtgggaaccgtcattatggggataggatcattcatggcctgtctggctgaaaaagggccatatatcattacaggaaatgtgctgcttgttgtgagcattttcatcatgatctatggttatgccaaatggcagccataaatagggggtaacaaaaagatctggaattatggaatcccttatatagaaaaaacaaagcgtcccggaacgaaagcttttagagccttcgttccgggacgcttttaatgtcagctccggcgcgggagcctgcaatgcaggctcttttatgtgccgtaatttttaaatttcttcgtagtggagaagcctttttcgtatctggctgtattttagtatggtagtatccacgtactcccaggtgtaaacggcagcggtgccatcctcgtcatagttcatggctttcagaaggagaaatgccttaggagggatgtgagagcgttccagcaatccgtttaacagttctacctccttgctgtaaacagcattcagttctaccttatcccactccagtttttttccggtggccttgtacatgaagtaaaaaacggattcaacgaaattgtccagctccgccatattcactccgttaagataggagaaggggatgtaatcccttgtgacggcgcatatctgtttatctgcgtagaagatcttgtcacaaataagaaccaggccgccttctgccatttcaagatgagcggcaacatccctgtccgccttgatgatatcatggtggatcatttccaccctgggcttatagccgctgctggttatcatgtccacaaaatgcatgacagggttaaagctggctttcatttcaaaaaagctgttattgatgaaagtccccttaccatgcctgcggaatatcattcccttggctgataagtcgtccaggacgcttcgaagcgtgatgcggctgacccccagcattctggacagttcttcttcccggggcagcttgttatttaccgatagatccatctgcttgataaaatgcagcagctctgtttctacctgtgtttttaaatctgttttttgtatacgccgtggttttggctccttgttttcttcggtcatgtaatcccccatcatatcttaggttaagagcaggaatatcgttgattacattttatcatgagagaattatattgtaaacagacgtctgagttttaagatttatggcagcttttctttaaattatttacgtacaaaattaaaaacaacataccaattggtatgataagtgtgtgaaaggtatgatgaattgtttctaatatttgtgatatatgcataaaatttttgagtataaattgtggttttataataataattcaaataaacataaaaatactatttacatacatcatatgttatgctagtattaggacagatgaaatggaaaaataactaaatggaaacagtaaaaagatttatttgtatacaatttatacaagctgatttgcggagaggaggagatatgagaaggaacatggataagatgcagaatgtggatgttcttccaatggctacggctcaaaaggtaaaaaccatgattatccaaagggagatgaagccgggtgaccggctgcctacggagaaggaactgacagaggtttttggagtcagccgttctaccttgagagaagccatgaagtatttaagggctgaaaatgtagttgtcatccgccaggggagcggaacctttgtcagtgctggaacagggatcggggaggatccccttgggctgcattttacggatcagaagtatcttattcagaatctgtttgaaacccggatgttaattgaacctcagattgcgggactggcggtacaaagggccacgcctcaggatattaagaatcttgagagactggtagcggagatggaccagattcagatcaacagcaccgctacggcagagatggatgttcagttccatacggctgtagcagaatgcacccataatgaagtactcattcgggtggtcccaataatcaatgaatccatccggcggagccacgtagaaacccataatgaccttgagagcttcaaacgggcaaaacgaagccataaaggtatttataaagcaattgccgacggcaattatatggaagctaaatttcttgccgagcggcatgtgtgggaaacactaaatgatgtaagggaaagggaagggaaaaaatgaaaaaaggattgattggaaagaaaacaatggcagtggttctggcagttcttatggccgggggagcgatggcaggctgttcttcaggcagcaaagaggccacggcggcaggtacacagaccacagcagctggtgaacaaaccacggcagcaggtacacagaccacatctgcaaaggaaggacaggctccttccggggatataaaaccatgtaccataaaatttcgctattgggccgataatacggattattcccagctcatgcaggatattatcaaaaagtttaatgaggaaaacggtaagggaattaccgttgtgggagaagaaagcccgtgggatgggggcgcatattcagagaatctgtttaacgctaagatgggaggcggagatattgactgtgccacatggaagcttacctccacgccgttatttgtaaacaacgatctgctggctgacttaacaccaatgatcaatgtgtgggacaaaaaggctgaaattgatgataacatttatgaaattatgaaaaaggccggagacatggagcgtatctatgtaatgccatggaacatccaggttctgtatgtatattacaggccctccatctttaaacaggcagggatagaggtacccaagacttatgaagaattcttacaggccatagaaaagtgcaccatggataccaatggggatggaaagacagatgtatacggctttggcatgagaggcgcaaaaggcggtcaggagccatggggcagctttgtatatggacggggcggcacctttgaggacttaacaacacctgaggcaatacagggcatgcaggatttcattgatatttataataaaggctatgtgcctcccacagccaccagtgacggattcagtgagatcattgccaatttccagtcagggctgacggccatgaccattcaccatacaggatccagcaaggatatggaaaagcttctgggagatgatgtatctgcattcgcgttcccggcaggtaaggggcaatggacatcaatgggagatacggaaacagttatatttgaatcctgtgaaaacaaagaggcagcctttgagtgggtatcctatctggcagcaggagaaggccagaaaatgtggtgtgagggaactggaaatgttccggtaagtaagagcgtccaggagactgactttttccagaacaaccgctttatgaaagcctccattgatggccagaagtttgcaggtatcattccgatccttgatacaactacagaatggatttccacgctgtggcccaataccgtttctcaggcactgaccggcggaatttctgccgaggagtgcatgaaggctttacaggccggattatatcaataaggaatcaaaaggtgagggggctgcaaaaaaggcggccccttccggttgggagggagaactatcgatggttaaaaaacggaccatatggccgtatgtactggtggctccggcagtgattatcattttgtgtgtggtgtttataccggttatgaatgcaattcttatgagctttcagaactatgatcttcgaagaccgaaagagattgcgtttcatgggctgaccaattatgtctctgcttttaaagacccgctgttctgggggctcttgttcgaaccattttatgggtggtatgcggagttggctttcagtttttgttcggattcattctggccctcctcttaaatcaggagtttttcggaaggggaatggtgagagcggtcagtatgataccctgggttacgcccggagtattgatcgggttgatgtggagatggatttatgacggcaactttggtgttctgaatgatctgcttttaaagcttcatgttatttcagataagataccttttctgtcccaggtgccgaccgcatttcccagtgtcattgtgaccatcatctggcagggaataccgttttttgcgcttatgcttctggcagccctgcagggcgtatcctcggaaatatatgaagcttccagcatagacggagcagcggcgtggcagaaacttttttatataaccattccatccattaagaatacgatttttgttacggcactgcttcgtgtcatctgggttgctaattcagtggatgtaatttttaacatgacggaaggcgggccggcctattccacccagacgctcagcgtttatatattcagcaagggaaatgcactgaatctgggctatgcttctgcaatggcgttattactggcagtattgcttttgtttgctgcaatcccgtacttaaaaatgaactttaaaggagaggagtaaaggatgaagaaacaacctgatatcaaacggattttatgtgtgtatctgccgctgactgcaatgcttatctttattttgttcccgttttattggacacttgtcacatccttgaaaccccaggatgaactgtacggcatggtagttacctacttaccgaaatccatcacccttgaatcctaccggaagctttttaccactacggttaatttcctggcagcaataaagaacagctttgtggtggcagcagcaacgactcttgtatccttaactgcatccacacttgccgcctatgccttttccagataccagtttgccggcagaaagcttctcatgtgcacattcctctgcaacaatatgtttcctacggtattgctgctgattccgctgtattccattatgcggaagatggggctgttgttcacgcctgcttcccttgtattatcttataccacctttaccataccattttccgtatggctgctgttagggttcttaaatgaccttcccatgtctctggaagaagcggctctggtagatggctgcaaccggggcattgcctttgtgaagatcattcttcccatactgggaccttgcctggtggccacaggggtttatatttttatgacatcatggaatgaatacacatttgcagtgatgtttaccaatacagagacgcgtaccattccggtggccttaaaaagtctgatcgggcaattaggggttcagtgggatttgctgacagcaggaggcatcataaccattattccggtatgcatcatgttcttttttgcacagaagcggttagtggaagggttaacagcaggagccgtaaaaggctgagttatataataaggaggaaaacaaatgcagtacagtaagaaagcaaaagaactgcgggccgaaattcttaaaatgttatttgcctgtcagtccgggcatccgggaggatccttatcctgtgttgagatgctgatggcactttattatgaagtgatgaatgtggatccaaaggatccggaaaaaccggacagggatcgtctggtcctgagcaaaggccatgcatgtcctgcattgtatgcggtactggcggatttgggatatttccccaaggaggatttggccggattaagacagattgacagccacttgcagggacatccggattgtacaaagactccgggagttgatatgaacaccggttctttgggccagggggcatctctggcaatgggcctggccctggctgccaaacatggaggcgaatcctatcgcgtatatgcagtccttgggatggagagtgccaggaagggcttgtatgggaggcagccatggctgcggctcattataagcttgataatcttacgtttctgctggattataacaagctgcagattgatggctgcaatgcagaagtcatgagcctgggagacattgtgaaaaaatatgaagctttcggatttgaatgctttgaagtggatggacacgatatttctgccataacagcagccttaaaggcgccggtaagagggaaaccgaagtttatctgctgtaataccataaagggaaaaggggtttcctttatggaagaccagtccggctggcacggaagaccgatgaatggggaagaatttgcccaggcaatgaaagagcaggaggtagagtaatggggaaatcactgagagttgcttatggagaatctcttgtaaagttaggtgcggagaatgagaaggtagtggtgctggatgcagatttggcacatgccacccagacctgtatgtttcaggaaaagtatccggagcgtttctataacatgggaattgcagaggcaaatatgatgtgtgctgcagcaggttttgcaaacaccggatacataccctttgccagtactttcgcattatttggggcaggacgggcctatgagcagatccgtaattccatctgctataccaatgcaaatgtgaagttcggtttttcccattccggcctttccgtaggagaagacggcggaagccaccagtcttttgaagacattgcccttatgagggaaatgcctcatatgaccatctttgtgccctgtgatccggcggaaacggagaaagccgtgatggctgcggctgaaataaacggaccggtatacatccgggtggcaagaccggtctgcaaggatattacaactgcagagacgccgtttataccgggaaaggccaatgtgatgaaagaagggaatgatgtctgcatcatatcctgcggcctgatgatccctgaggcattaaaggcagccgaagagcttgagaaggaaggcattcatgcagcagttgtgaatatgcataccatcaaaccgattgataaagacatcattttaaaaatgaatgatatctgcaaaggcattgtgaccatagaggaacattctgtgatcggcgggcttgggtcagcggtggcagaagtcctggccgggcatatgggcgctaaatttgcgtcattgggaatacaggataagtttggaaaatccggaaagccggaagaactgtttgaggcttatggacttaccgccggacatgtagtaaaagcctgcagaaatatactgggttaatgggaggataaaatcatgaatattgccgtttacgagtttgcgggcgaaggaatgcagagagtatttgagaatgaaaaatggaccgttggcatcaaaaactggaaacccgccaatgatgtgtcaggaattgactgcctggagaggcacaacaaaacagacgaactctttgtgcttgtggaaggatcgtgcacccttgtttatgccaatgaatcagaaaaaggcctggaatttgccacggttcacatgcagcctgataaggtatataacattccggcaaccttgtggcataacaccattacccaaaaggatactaaaatgattttaattgaagattccaatacttctatggataacagtgatattttggaactggatgaggagcagatcgccaagttccaggcggattatagggctgtattcggagaatcgtaaaagtatagaaggagcgtgctgtctgcagacagcacgctcttcattaagatatgaccactatttcctgttgttccaccacatctccggtaatgccgaatgcttttaacacaggtgtatcttctgccagggagaggatcaaatagcttgcaaaaggatcataggccagccggatatcctcttgtgagggtctggcaggagtagatgggtgagaatggaaattcccaaggggtgaccagccgttcccccgcatatccttgattgcggagagatgctctttggggtcaatggagaaatgctccgggctttggtcgggattggaaagcagatagaccttttgaaccgtcttactgtggccctccacagtacctgcgatcaatccgcagacttcgttgggaaggccttccctggcgtgttccacaattaatttaatatcagtttcttttattgtaagcttcattttaaatcacacaccgcctgttcataatcaaagggagccaaaatagagggggattctccgcatacctggcagtctgagggctttggaagtttgactttacgaaatgtcatggttaatgcgtcataggtcaggagtgagccggtcaggagttcccccttaccgatgatatatttgatcgcctccattgcctgaagggagccgatgactccgcccatggcaccgatcacaccggcctgtttgcaggttggaactgcatccggcggaggcggatccttaaaaacgcagcgatagcaggggccctgccccggtacataagtcatcagctgccctttgaaccggataatgccggcatgagaaaaagacttcttcgccagtacacaggcatcattaatcaggaactttgccgggaaattatcggtaccatcaatgataaaatcataatcggcaatcagatccataatattgtctgccgtcacaaaagtacggtaggttttgacagtcacgtcagggttgatggcctcgatgctttctttggctgattccaccttggctttgcccacgtcgggcgtgctgtgaatgacctgacgctggaggttggaaagatccacttcgtcagcatcggctaccccgatggttcctacacccgcagcggccaggtacagcgcacagggagcgcccagtccgccggctccgatgatcagtaccctggcatccagaagctttttctgtccctttacacctacctcggaaagaaggatgtgccgggaataccgttccaactgctcattggtaaatgccatatcactgccctccgcccataaagtataaaaactccacgctggcaccgtcgtgcagctgtgtttcgccgaaagcatctccggaaataaactcatcgtcaacagatacagtggcatattggggtgtttctatctgctctatttctatcagctgcgctacggtcaggccgtcagcgtattcttttttatttcctgctacagttagtatcatttcgattcctccgtcatttaattgatgtgctaaaagggaagataattgctgacatttatcttacagattttaaatctgctattctccggcctttcgcacgatcaggttataggttccgtcttcattctctgttaagcgcagaatttgatgtccctcgtcctttacactgcggggaacattttgtaccggttcgccgtcgtttaaacgaatggacaggatttgtccttcatctaactcctcaagtgccacttttactttgacaaaggtgaccggacagaccacgtctgtgatatccagtgtttcatttatattaaaatcagccatagtaagcaacctccatttcgcgtttgaattcatcccagccggtgcgttcaatggcgacccggaaccgctcgctgggttttgcattcctgttgaaataatcaagtgccgcatcggttacacgaaataaggtttctttgtcgcggatgatgggcaaaaattgttgtcctttggcaattaagttgccgaaggtcccccgaaggagatcagatatcccggttcgcttttccaggcgtcaaaggggcaggatttggcgcagcggccgcagttgctgcatttatcgcgatccatgagaattttgccgtctgtctgggtgagagcaccatcccggcaggctttggtgcatacaccgcataaggtgcaggcctcttgaatccattccactgtatagccgccctttatgcccagatcattttcctctgccttgaggcagttgttcatgcagccggtcaccccaaatttgaatttatgaggcagttcccgtccaaaatagcggtcggaaatttctaccgcaaggggataagtatcaatgcagccggaggggcaaatggcgttgccctggcaggcggtgacggttcgaacccggggaccgcagacgccggtgttcacgccgccgtcttccagttccgctttgactgcatccacatcctccagcttaataaaaggaatctctatgccttgacgggaagtaagatggacatggccgtcgccgtatttctggctgatttcggcaatcacggccagctgttcagcggccagattgccgccaactaccttcagccgcaaggagaaatggtttttctgtacctgacgcataaatccgccgtttttcaattctttgtagttaaccgccataatgatccccgctttcctatatttttgaaattgcctgtgcaaagtcttcttttaaatcttcaatatcttccagcccaacgctgacacggatcaggtcgtcatatacgcccgcgttttgttttgtctcttcgcttgcatgattgtaaatggtggaggcgggatgaatcaccagagtgcgtacatccccgatgttggttgcgatgcgaacgtatttcagcgcattaatcaaaataaacgcgttttcttttgaccctgcacggagcgtcagaatggccccgcctgcgccgccttccatctggctgtcgatgagcggcttataattgctgctctttaagccgggataattcacatggactccaggtgagttttccagaaattctgcaagtttcagcgcgttttggcaaagccgctccatacgcagtcccagggtttccagcccgatacagtttaaatatgcgttttgcggagccagacaggagccgaagttacgccagatatcctgccttaaccgggccgtataggcaaaaccggcaaacttcctgtattttgcaagcatcggaaatttatcaaaatcccaggtgaatctgccgctgtctactataactccggaaatggcgtcgccgctgccattgatgtatttggaagaggagtgcaccacaatctgtgctccgtgatcaagaggccggatgagagcagggctggcggtagtgctgtcgatgatcagcggtattccatggctttcagtaacatcggcaactgcccggatatctaccacatccagctttggatttccgatcagttccgcaaagactgcgcgggtgtgtggggtaatggcgctttcaatttcctctgccgtcacattctgaacaaaacgtgtagtgattccgaaagcctccaggtcagagagaagatccagagttccgccaaacagaccgcttcctgctataatttcatctcctgcttttaaaatatttaaaagcgccatgctgacagccgccataccggaggaacaggagaccgcatccaggccgccttctaaaactgcaattctcttttcaaaagctgaaattgtggggttggatatacgcgtataggcaaatccagaggccgtattggcaaaaaccttttccagtttttcggccgattcctgggaaaaggctgatacctgatatacaggaggaagtgttgcgccctggaaatcaggaggaaatgttccgtgtaaaagcctggtgttaaatttcataagaatcctcccaaatcagcacacggcggtattttccaaaattccggggcagttcatcttctgtcggaatgccgttggtatcgatcagcggcgtcttttcatcacggctgccgaatccggcaaaaactccctgacgaatatgtgcgaactcctgggcatagggcaggtcaaaatcaagaggataatcaaacagatcggtttttaaaggaagggcatctcccactttataaaccgctggatcagggctatgacgcagcacagcatgaatgcccggatggtaataaaagttatcaaacagccgaatggacagttttttctctccatcctgcaggaggacatcctcttgtttttgttcgtctgtctcttcaatgacgccgcaggcggtcgtagagtgccgcactctgtcgattaatatcaactcgcccaggcttttatgccgtttgaattgatccaatacaataggctcggacaatgagatttcacagcgcagtatttcgttcttacccactgattcggcgggcagcagtgccccgctgtttatatccactttatgctggatgccagtcacaacggccggacatagctttgtacccagtttgagtaaatattcctttccgggaatcagattttcttcatccatccatagaagtgtggcaacaaaggtcctttccagcttgaggcaggcgtctttaaccagcacacatccccgggacacatccacttcccggtcaagctgaatggtgaccgactgccccacagacgattcggccgcatttttcccggcaatggaaatggattttacaagagcatgttctccgcttggcaaggcggtcagctgatcgccgactgatacccggcctgcctctatctgcccctgaaaccctcgaaagctatggtcgggacggcaaacccgctgcactggcatataaaagcctgcttccggctgttcaccggaaatatccactgtttccagatgggagagcagtgtttccccctggtaccacggcatgttttcagaatgtctggtgacattgtctccttctgtggccgaaaccgggatgataaccacatgttccagtgacaattcctcgcacagagtcacgatatcttctgatatctcgttgaatttttccctgctataggaaattaaatccattttgttgacggcaaaaatgaaaaagcgtatccccatcaaagaacagatcctggtatgccggcgggtttgcgccagcacgccctgggatgcatctaccagaatgaccgaaagctccgcaaaagaggcacccaccgccatattccgggtatattcttcgtggcccggcgtgtcggctacgataaagcttcgggcattggttgtgaagtaacgataagcaacatcaattgtgatcccctgttcacgttcagccatgagaccatctagcaggagagaatagtcgattgcgccgcccctgcttcccacctggctatccagaatcagtgcctgttcctgatccgcataaagcagctttgagtcatatagaatatgtccgatcaaggtggatttaccgtcgtccacactgccgcaggtaataaatttcaaaagtccgttttctgtactgcccattaaaaatacccctcccgtttccgacgttccatgctgccggccgcctccttatcaatgacccggctggtgcgttcacttgtggccgaggccagtgtctccttgattactgcatccagtgtatctgcttcggattccactccgccggtgagcgggtagcagcccagtgtgcgaaagcggacttttttgagctgcggaacttcccctggacttaaacgcatccggtcatcgtctgccatgatgatgtttccatcccgataaaccacaggacgttccttcgcaaaatacaagggcacgatgtcgatattttcccttcggatatattgccagatatccttttctgtccaattggaaatagggaagacgcgcatgctttcccctttattaatctgcgtattgtataatttccacatctcaggacgctgatttttgggatcccatgcgtggtattcgttccggaaagaaaagatccgctcctttgcacgggatttttcctcgtcccgccgcccgccgccaaaggctgccgtgaactgatacttggtaagcgcgtctttgagcgcctgcgtcttcataatatcggtgtatgcggcgccgtggtcaaagggattaattccttgcgcgatggcctcttcgtttcggtagaccagcatgttgatgcccagctcctttgcgcgacggtcacgaaatgtaatcatttcatgaaatttccagctggtgtcaatatgcagaaaagggaaaggcggcttttccgggtagaaagctttcagggccagatgaagcattaccgacgaatcctttccaatagagtatagcatcaccggacgttcgcactcggcggctacctcacgaaaaatatagatcgcctcagcttccaattgatctaaatgtgtcagagacatggggatctctcctctcttgatataatctgttttttacggattaattctgcgcctgcctgtgtcactgaatacaggtaaaggcgtttagtatttgttggcgctgcggctgtctaccgttagggtttttgtgctgccatccggatttgtgagtgtccagtgcagctgtgtaccggttcgacggatagtaaaccggccgcccagtcccccgatgtcctcgcctaaatagagcgcaatggcctgtaccggacattccttgaggcaggaagcgcagccccagcaacgctccggccgtaaaatttcagcctttccccgttgtaagcgaatcaggctgcctggacagatgcttcggcacctgccgcatccaatacattgctttgatcttatttcaatgctcatatgcttctccttccccaacaagcggccggaagagaatctttaaattgccgttctcaagcctggaattgacatagcattccatttcggaactgatatccgggtaatcggtgttctctgcaaagctgtgccagcgggtttcccggcgggccgccaagtgggtgatcactgaccggcagaggattaatcgttcacgcagctccagtaagtatacaagttcttgcatatccgacgcagccaaagcatttgccagcctttgaatctcctgaatctttttatcggcaatgcggagggagtcttcagaaaaacggtagtcggagccaatacctccggcgtattgatccatgacggactgcattttttcttccaattcatctgtggtaacactggctttatcattatttagaaattgctccagccagagctttttttcagggacttgccctgcgtccggcagctccgccccttggcttatgtagaaaatagctgcattggctgcgatttccccctctgcaaacgcgccggtcacatacttttgggggcaccctccggccacatctccggcagcaaacagaccctttatggtggtttcccgattggtatccacccaatagccgctggccgtgtgtcctcccacgatatatggttcggttccttcaatttccacattcttgacgcggggtgtttcaccgctttccagccatcttagggtttggcttggcgccatgttgagatatgccttctgtaaatcctcatcctgttctgcagtgatcccaatggtgcgcagggtgcagggaccccggccttcacggttttctgtcaccgttccatggagacgctgggaggtggtcaatccatatttctgttcataaatctctccccgggaattgatctgctttgcaccaacaccctgagccagcgttcctgtaggtgcaatggtatccttgcagcgcagggcgataaagcgcatttccaaagtggtcatctcagcacctgccagaatgcccatggcatacccggcgccggtattgaagggaggataccacattttgtgccgggaaaatccggggtggttggggcggtacaagcccgccgcgccgccggtggcgcagagtactgctttggctgtaaggacgtacagcaccggttcatctatgctgattgcataggccccctgaatgcgattatccttaacaatatactcaaacacgttgacgcggttcatcactgtaatttccggtttctttgacacggcatcggctaaaatcggttttatgttttctccgtttattttaatatttcgattgccgcgtatggtatatccgccttgtttatccttgagaatcgtaagtcccaatccttccagtttttgtgctgtccggttcagtctctcagccattgtcagaagtaagtcaccgcgcacaatcccttgtgcatcgttacgggcgtaatccacataatcctgaggagtttttcccggaacaatgtatgcgttgattgcgttgactcccgcggccaggcagccgctgcgccgtatatccgccttatcggcaatcagtatgcggccgcagctttgttcactgaatgtcaaagcagcataacaccctgcggtgccgccgccaatgattaaaaaatctgtttctaaatattccgtacgaagcatcttatttacctgttccatgaaatcacctactttatatatgggaaatgtatgatatgactcattttacctgttctaaagatggaaatccagagtaaattacgcaatcgttacacaagaaaaacgcaagatcatggcaaaaactggcgcaaacgttacacaagatttatcttgctttttcatatttaattgtatatcatactaaacatatagatataatatgagttatccgaatatgcagagcaagtgaggagaaaggggcgctctttgccccgtccatccgattatgggaggtgctatttacttcccataatatgttaagaggggagggtaacagcatgacattaaaagaagttgcagcgcgggccggagtttctgtgtccaccgtttccagaattatcaattcaacggacgggagtttcgcccgcaaggaaacccaggaccgggtatgggctgtcatcaaggaaaccggttatatgccgaaccaaagtgcacggaatttgaaaaggggaaaaaacggagtgcagcaagctccggccggaacctttgcctgcattttagggagagccaagactttggatgataatcccttttttgctcagcttgcgcaggtaattgagcagcaggccatggaacgaaactatcctgtgcggctttcttattcagtttttgatattaaaatgatccctacccttgaaaaaattgaatcggcaaaagtggatggcgcaattgtgttgggacggttcagtgaggcagcaacagcattcctggagtgtcattacaaaaatatcgtttatgtaggacgaaatttaattcatgctgagtgggatcaggtaatttgcgatgggtatgaggcgacacaaatggccatagaacaccttgtgtcctatggtcaccggcggattggctatattggtgaaacagacgatgaaatacggtaccaggcgtatcgtgacatgatttgtaaatgcggactggaagacaaccggcgttttgtttgcaatgttccccacactggcgaggggggataccggggggcggatctgcttttgcgcacgggagctggattgcccaccgcagtcttttgcgcagccgatgtgtcggctattgctgccttgcgccgtttcagggaggcgagaatcaaggtcccggagcagctttccataatcagtatggacaatattgaattgtccagctatgttactcccatgctgacaacagtaggcatgccaattgctgaaattggaagcatggcggtgcagctgctcatcggacggattcacaaacaacaccggcttccgctgaaactgtacctgccaaataagttgatgcggcgggaaagcgtattcaatataaacgaaggaatgtatatatgaaagacaaaatgcgatgggatatcctgctggtcggttttggcgatctggcggttttagagggtgaggtgagatttctgtttcccggctgccgggtcttttctgcacgaacggtacaggcagggctggaacagtgggaatcagacaatatttttgttcagccggtacatttactgccgggttttgaatatgaaaagctgcttgctgcaatttccttttacacgaaaaatattgaggttggtaagcctcttctgcattcagaggaggcgattacatgttttgcagagattctccataatgaatacggggggaagccaacactgtttgtggggcatggctccggtcatcctttgggtaaaactatgtatatgcgtctatcggaagcattgcaaaaggtgggattttcacaggcatcggttgctgttttagagggccagccggatctgggcatatcggtgcggttcttccggcaaaacgcgcactcaaatattacgcttgtccctctgactttaacggccggcaagcatatgcgggaggatattctggggaaccatgaggcaagcatggaaagacggcttatttccaatggttttatggtaaagcccgtccatcgctgcttgcttacgctttcccctatccggcagatgttcctgcaaaatattgctgaatgatttgaacagagtgaggattgatgaagttgacacaagagatatcaattaaggaaacacaataaaagagaacacccttgtgatgcggaacgatgaaatagaaatacgaatttctaaaaataaatttatatatacagcataaaggattggttatcgccctgctgcacgatagcatcctgcaaattctgcagtgttacacttacaaggcagtctgcaacggccttatccaacgggttgaaaatcaattcttccagcacaagtacattagccggcgactgtttcagccctgttgtttctgtcttttcaaagagcccgccctctaccgcaaacagaatatccagtgcggtaatgctgtccgctgcccgggccagacgatagcctccattttttccttttgtggaaagcaaaaggttgtttttctttaaaagcgtgatggtttgttccaaaaatattttagaaacgccaagcttttccgcaatgttataggtggaaactggtttccccaatgcggtttgattcgcaatttcaatgagcgcggctattgcatagctgcctttggctgatattctcaaacaaaattcctccataagttgtgtgattacttccatatcaaatgaaaaattaattaaatacatactaaacatatctataatcttgacattccagatctaacggaatatgatagatatcataacaatttactatattgtactgggaggttataaagatgtcaagaattgcatacagtttaactgagttaatcggaaaaactccgctgttgaagctgaaccggtatatgcagcagaaggagctttcagctgtgctgctcggcaaacttgaatattataatccggcagggagtgtaaaagaccgtattgcctgggctatgattcgtgatgcagaggagagcggcaaattaaagcctgattctgttattattgaaccaaccagcggcaataccggcattggactggccgctgttgcggcagccagcggataccgtatcattctgacgatgccggagattatgagtatagagcgccgtaagctgctggccgcatatggcgctgaggtagtgctgaccgagggtgcgaagggcatgaggggagcaatcgttaaggcccaggaattggcggaaaagacgccaaattcctttattccagggcagtttgtcaaccctgcaaatccacaggtgcatcgggaaaccaccggaccggaaatctgggaagatactgatggtcaggttgatattgtggtagcaggtatcggcactggcggtaccatcaccggagtgggtgaatatctgaagaaaaagaattccgccttgcaggtgattgcggtagaaccggcagattccccagttctttccgaaggccgtcccggcccgcacaaaattcagggcattggcgcaggctttgtaccggagacactggatacctccgtctatgatgaagtaattacagtgaaaaacgaagacgcttttctggcgggacgggaaatcgcacataccgatggacttctggtaggtatctcctctggtgccgcattatgggcggcaacagaagttgccagacgtccggaaaacgcagataaggttattgtagttattctcccggataatggtgagcggtatctttccacagctctctttgaaaattaaaaattgcctttaaaaggaaccgtcgattatgatggttcctttttaaatttatgaagcaaaaaccgctggtatatgtacagatgaccactgcttaaagcaataaaagcaaacgtttgcttaatttcccgttgcaaaaattgaatcagattcgtataatgcatagtaaacatatttgttttatatgtaatagggattgggggtgaaccgaatgcggaaaaaacctactcttcgcatgatttcgtattgccgatgttatatgcttagtcattttgctgctggaaaaacctgcggcatgaaagatctgaggcataaaaatatcgtgatgaaatgagggatttctattatgaaacgtacaaatattttttccaagagagtcttagcgccggccatcgtattagtttctgtccttggtgttttgacgggctgctcaggcaaggctgtctctcctgacgctgaccgtggggcccctgaaactgtatctattacaaatgtttcctacgaccctacccgtgagttgtatgagcaatataacaaactcttccaaacctattgggagcaggaaaaagggcaaacagtggaagtcacccagtcccacggcggatcaggcaagcaggcacgttccgtattggaaggcaacgaagctgacgtagtaacactggccctggagggcgatgtagatgaactgcgcacaggcgggctgattgaagatggctgggtagacgaatttccaaagagcagtgccccttatacgtccacaattgttttcctggtgcgccaaggaaatccgaaaaacattaaggattgggatgaccttgtggggactggtgttgaagtcatcacccctgatcctaaaagctccggcggtgcccggtggaactttttagctgcctgggccttctccgataaaacatatggcggggacgaaacaaaaaacaaagagtttttacaagcgctatacgccaatgtatctgtactggattccggcgcgcgcggagcaaccactacatttgtagaaaacaaaaaaggggatgtgctgttagcctgggagaatgaggcgtttctttcggtggaagagcatcccggtgaatttgagatcataactcccagcttaagtattctggcgcagccgtcagttgccgtggttgacgccaatgccgaaaaacatggaaccacggagatcgcaaaggcttatcttgactacctttattcagacgaggcacagcggttggaaggagaaaattattatcgtccttcgaatcctgacatcctaaaagaatttggagatacctttgatctcaatatccagctggtcaatatcaacgatgactttggagggtgggcctctgccagagagaaattttttgccgacggagcgatttttgatcagatttatcagaagtgacacggttgtaatcgccgggtacagggggaatcatgcataattttgaaaaacctattttaaaacggaaaagcagagtgataccaggatttggcctttccatcggcatcacgatcacaatgctcagtttggttgtgctgatccctctgttttctgtattcttacttctttccgattctacgttcagcgactttttgagagtgattactgataaacaaaccgtagcggcctataaggtcagtctcagctgcgctgcgattgcagctgttgttaatgtagtattcggcattttgctggcctggattttaactcgttatcaatttcctatgcaacggatattggatggcctgatcgaactgccttttgcgctgcccaccgctgtggcaggaattgcgctgaccacgttatattctgaacagggctggatcggcagattgtttgcgaaaattggagtggaaatttcttattcgaaaattggaatcatgattgctatgatttttatcggaattccatttgtggtacgctccattcagccggttctggaaaagctggacccacagtatgaggaagcggcacaggctttaggagccagccgctcccgtactttttttaaagtagtacttccagagattctgccggctgccctgactggtttcggccttgcgtttgccaggtccatcggtgaatacggcagcgtggtgtttatcgcgggaaatattccctatgaaacacagatcgtaccgctgatcatcatgaacaagctggaacagttcaactatccggctgcaacatcaattgctttcataatggtggtatttgcgttcctgctcctgttcggtatcaacctgattcaggcgcgcatccaaaaaattgcaagggggtaagggcgaatgaaagagaaaatcataaaatggcttttgattttacttggagcggcgtttctgggcatcatgcttgtactgcctcttgccactgttctggtatatgcattgcgtcaaggctttgaggttttcttccaggccgtcacagatgactatacggtgaaagcattaaagctgaccctgtttacgactgtcatttctgttgctgtgaatacactgtttggtgtctttgctgcctgggctatttctaaatttcagttccggggaaagcaggcgctgactacgctgatcgatatcccattctctatttcccctatcatcgcaggattggtgttcattctggtattcgggcgaatcggctgggcatatcctctgctggaggcatgggatattaaaattgtatttgccgtacctggaatagtattagcaacaatttttgttaccttcccctttgtttcccgtgagctgattcccttgatgcaggcacagggcagcgacgaggaagaagccgctgccctgatgggtgccaaggggctgagaatctttcgcaaggttacctttcccatattaagtgggggcttttatacggcatcatactctgcacagcacgggctctgggcgagtttggggcggtgtcggtggtatccggtcacctgcggggtaagacaaacacattgccgctgcacgtggaaattctgtttaatgaatttaaactgactgcggcttttgccgtttcctccattttggtgttgattgcgatattgatcctgattctgcgcaatattgtagagtaccgtgtcaaacgggaagagaggtagagcctatgtatgtacagctaaaaaatatcaataaaaagttcggttcttatcaggcagcggaaaacatcagtttttccattgaaaaaggaaagctgattgggctgctggggccctcagggagcgggaaaacaactattttacgtatgattgcaggactggaggcaccggacagcggtgatatctttattgatggtcagtgtgttaacgatcttcctgccagcaaacgcggtatcggttttgtatttcaaaactacgccctttttcgttatatgacggtttttgataacattgcatttggtctggaggtacagaaaaaggataaggcatataccaaacagagagtaaacgaactcatcgaactcatcggtctgaaaggactggaaaaccgccggcctcaccagctttcaggcgggcagaagcagcgtgtggcttttgccagggcgcttgcaccgaaacctcatgtgctgctgcttgacgagccctttgccgctattgatgccaaggtgcgcaaagaattgcgtacatggctgagagagacgataaacaaggttggaattaccagtatctttgttacccacgatcaggaggaagcagttgaggtggcggatgaaatcatcatcaccaatacaggccatattgaacaaatcgggtcaccggtggagatttataaaaatccggctacgccttttgctgcgagatttattggtgaatccattattgtagaggattacagccggctcagcggttttgaatttgaaaaaggctatgaaaaggctgttcttcgtcctgagttcataagggtcacaagaaaggacaaagaggtttatccacacgcttctcaacgtgcaatcgtagaagacagcttttttcgcggcaatatgttagagctgagattgaatgtgggtgggataaagcttgttgcatacaggtccttagaagatgaatttctcgctgtgggggaagaagtcagtgtgctgatttaccgtctgtatctttacaatgacacacaggtgcgcctggcggaaaacaggtcttttcagcccagtgatatatttaccatctgacagttcagcatttataacgctgtttatttatgaattctgtttttgtcatggctgcatcggtgatatgtgtcttttctgttatcagctcattttggaggcgataagatgaaccttcttttaaagtcaggcaccctgtaccggatggacaataaggcttccggtccggcattggccaacattcacaaccatatgttcggtttggaaaagcaaatcattgcaggagaaaagcagttccttacccaaatccggacggagataccaacaggagagcgaatccttggtgtctgctccaggcaatacctgctgaaaaattctgacggcgagattctgttatccggtgttcccaaatatgcggacgaaaacgacccctccattgttgggcagttcagctataggatgccacgggtaaattccgctgaactcgtgtttcaggaccggagcggacttctccgaatgatcaacagccaaaactaccgtttgaccgacccttccggcagagtgattctcactctcctgcgcaggggtatcttttccggtggctggaatcttgacgcagcagaggagcttcgtcccgagtttttgtgtgccatctttatattttgccggtatatggagcaggagaacgaattacctattgtataactgcagggacagcagcacctttagaaggacaatggcaattgccccataaattaaccttggaatgtctatttcagaaaaagtttccatttataataactctatatatggttgaataagtggatatgaagaatagggagaaagtgcgtttccaggacctgggaccgcgctttattcgtattagtatgagatagaaaaactaaggcaagaagacctggagcttcataagaaacccggactattaaagagagcttattgaagagacctgttataagactcttaaataagctcaagctgctattcggttatgagcaagtagcgaagcggattgcgaatatccgcttgactacattgaattatattataatgtcgggcagattcattctgctcccggatatataaccccggctccattcaaagaataaaattcataaaatccgcttaactttgtgtctgcaaaatctaggcagtttcaggataagcttttttcaattgtccacttggcggtacgcacaccaccgccatttctgcgccgttctattatttactgtaagccttctttgtattgctttaaagcttccgcaagctggtccggacaggaagtgggcctgtagccgcactggattccttccagccttcttatggcttcatctacatccattccttccaccaggcgtgacacgccctgggtattgccggagcatccccctacaaactggacttgtaccagtttattgtcttccacctcaaaattgatttcccgggaacagactccgtgtgttttatatttcatttctgattcctccaatttgtaaaccgtttcttgttacgaactttaaaattatagccaaattccggtggggttgtcaatagttctttgcaaactggcttctaaccgctataatagaaggaaatacttataaaaacaatgcatggaaaaggagaaaactatgttaggaattattggagccatggatgtagaggtggcggaagtaaaaaaagccatggagaatgttacggtagaaaccatagctgcaatggatttttatagaggaaaattaaaaggaaaggaagcggtggtggtccgctccggcattggcaaggtaaatgcagcaatctgcactcagatcctggcagatcattaccatgtgaccgcagtcatcaataccgggatcgccggttctttaaagaatgagatcaacatcggggatgtggtgctgtctacggatacggtgcaccatgacatggatgcaacaggctttggatatcctgcgggacagatccctcagatgaaagaatttgctttccgggccgatgaaaggcttcggaatctggctgaagaatggtgtaaaaaggttaatcctgagatcggagtttttactggaagagtggtttcgggggaccagtttatttctgatagggttaaaaaacagtggatatccgaaactttcggggggtactgcacggaaatggaaggggctgccatcgcacaggcggcatacttaaaccatatcccgtttcttatcatcagagctatttcagataaggcggatgacagcgcaaacatggactatggcgagtttgaagagaaggcggtaaggcactccgtaaaccttattttagccttggctgaacagtattcatattaagttgagaatcgaatcctgacgggatttgacgaacgattctaggctttctcatcttcccaaagccggacagggtgattataataaacctatcaccggtcgaaaccgggaagaaaggggagctactattatgctggaatttttacagacaggcaaagcgctgtacgtgcttgcagccctatgcggcattggcattatcaccagatggctgacacgtaacctctacaaaagattgatcaaagaatcggacaaccttacactgaccaaaaacaaaaatcttcgggcgtttaagcagaagacagaaaccacgtaccagatgaaccagggaatcccaaaggtaaagccgtatctggaacggcagatgtatgattttaaacatatgggaattacactccacggatggaatatgttttccaaccagatgacgctatggtgctttcttataggaggtgcggcagcattcgcatcctactggtaccgcaccgattcttattacatagtcttgtatggctctgcgggaatcatggccggactgtttaccatactggtagaccacggcgcaggaattacggagaaacggcagcagctgtttgcgtctctggacaattatctggaaaatacgttgatttaccggttagatatggaaagagaagaaatacaggcaatatcggggcctcatatggaaacccgtgaaaatataagatccatttatcccggtaccacaaagagcgtggtggaaagtgagccggagcaggacaagaaggctgacaggagaagtgctaggcagagaaacggatccttggaaaaggcaataaggaaccggccgcaaaagcagtccatggaggcattccctgaaggcggggaggccggagcagaaagaggggaaatccagagtcagccggatgtgaaaagttccaggcgtgatgtggattacttaaaacgaagcttagaacagattgccgccagcagggaaagagagcggggaaacaggcagggagaggactggcttaaggatctaagccctgatgagctaaagctgatcagtgaaattctccaggagtatttaacatgaacatttggaaggcataaagaaaatcatgtcgcatttaagactattctgtggtataattttcctaagcagggggtcagaaacctgaagtcaaataagccatagcaacctatggactgtttggttttgcaggcagttgccaaggtcaagctcgcttgacttcggctcgttgcctttgccagaataaaaggaaaaggagaatattagcaatgggaaatgtaatttttgattattccagggcagcaggctttgtgtcagcagaggaaatggagaacatgaaggccacagttatgtgtgcgaagaacgtgctgatggacaaatccggtgcaggcagtgatttcttaggttggatcgaccttccggtggattatgataaggaagaattccagagaataaagatggcagcagagaagattcaaaatgattctgatgttctgctggtcgtcggtatcggcggttcctatcttggagccagggcagccattgaatttttatcccacagcttttacaatgtattgccaaaaggaaaacgcaaaactccggagatctattttgttggaaacagcatcagcagcaaatacatccaggatttaaaggatgtgctggatggaaaggatttctccgttaatattatatcaaagtccgggacaaccacagagccggcaatcgcctttcgggtatttaaggatatgctgattgagaaatatggccgtgaggaggcaaataaaaggatttatgccactacggataaggcaaggggcgcactgaagaatctggctgatgaggaaggatatgaatcctttgtagttcctgatgacgtaggaggacgtttctcagtgcttacggcagtcggccttcttccgattgcggtgtccggtgctgatattgataaattgatggaaggcgcggaggcggccaggcaggaagccctggaaacagcctatgagtcaaacggtgccctccagtatgcggctgtgcgcaatatcctgcttcgaaaggggaaaacagtggagatcgtggcaaactatgagccaagccttcattatgtttccgagtggtggaagcagctgttcggtgaaagcgaaggaaaggatcagcgggggatctttccggcagcagtggatttgaccacagacttacactctatgggacagtttattcaggatggggccagaattatgtttgaaacggtcctggaggttgaggaatctcctgcagaaattcttcttaaagaagaaaaggtagataccgacggaatgaattatctggcgggaaagagtgttgactttgtcaataagagcgccatgaacggaaccattctggctcataccgacgggaacgtgcccaatttaatggtcaggatcccgaagcaggatgaatacagtctgggacagctgttctacttctttgaatatgcatgcggcatcagcggatatattttgggcgtgaatccgtttaaccagccgggagtggaaagctataagaagaatatgtttgcactccttggaaagccgggatatgagaaggaaagggaggagcttttaaagagattataggacgttggcaaacagcgccggtgttctggtttggaccttcataaaaggccggaccagggcaccggttttttaatatttggattttttggaaataataaagagttttttaagaaaatctttgatatgaaatggcaatgcagtatagtatacttaaagtgcgtgactaaaaacaattcattcaaggaggaagatatgaaaaaatgtttaatgcttttccttactttggcaacagtgctgtcattggctgcctgcaagggggaaaaggatccaaaggtgctctatgatgaggcttccaagaaaacgtcggagctggcgtccatggatgtgacctcagtggtcaacatgcagatgacgcagggagaaaacaccacggatatcaaaatggacctggatatgaaaatggcggatataaacacagagaacatgaggtatctggcacaggggaccacctccctcatgggccagagtatagatatacttatgtattatgagaatggatattattatatggattccatgggccagaaggtgaaatacgccatggatttaaattccatgatggatcagatcaagcagagcacagagggcgcaagtgtaaattcctcttatttgaaggaaatcacagcaaagaaggatgggaataaccagattctcacctttaccgttgatgctgaaaagatggatgcttacgtacaggatttaatgggccagctgggaaccaatatggaaggggtaacctataccattaaggaggccagcggagaagccacagttaataaagatgggtattttaccaactcaaagattaagatgtcccttgaaatgaatgctcaggatcagacggtagccatggttatggatacggattccacctacaacaatcccggtcagaccgttgaggtcacggctccggatctggaagggtatacggaaatcgacgcaggagcactggagaatcagtaagaataattaaaaagcattcaggcaggggagccggcaaagggttttcctgcctgatgctgcatatgaaagcttctgctcttgttatccaaaggatataccgggtttactttaatgtggaagcaacatacatccgttcagaatttccatcatcgcctgttaccgttgtgaggaattcccagccgcacctttcataaaattccctatggcctgtaattaaatataacttttcaaatcccatatcaccaagatcttttctggcaaaatctaaaatatactttgcgattccctgattgcggtgtttttcttctacaaataaagcgcataaattagggcttaagtctttccggtcatggaagtcattatctataattcccgctcccgcgataatttcctgattttcgtctaaaacaatataccattgaggtattcctgactttttgtcaatgcattcctgaatgctttctttgtatgcttcaagaggaatgacccatttttgaaagaaccaggaggccgcggcttccaaaagttcaggatttttgcataatttctttaatgtcatggtttccatttttatagttcctcttccttcaaagtccggatcagcctgttaagatagaatatcattatcagaagcagaaagatataagggaaattccataaagggctaaagcttatttgataatataatctcaaacggttccttctccagtataaatccgccaatagcctggtatcctaattttacatagaaatgctggctgtattcatctgatcgggcagaggtcataaccgagtgatatcccaatgacttcatctctttttcccaatactccgtaagctgtttcctattttaagtggattgcagttcacggcctcctattcttcaattacctggatttccagaaaatcaaattcaatgtgctcgataaaattatcctgggtaaaccggactttggaatgcttttgaaattcatgaatggtagcatccagccatatgggttttccgagatcgaactggagacagatatcatctagtgcctgaaagatcatggaggtcctggaaagactgtagtcagagatggagatgactgtgtctttcatgattttggtgtctttcattaattttgcccacatgcgaaacataagcgaattttcctttctgaaattggcagctttatcagccgtttttatgatgcaacgattatagcattaccttgcagaaaaaggcaagaaggaaaatgacggacgttgtaaaaccttgaaaaatatggtagaatctttgtaggaaaaaccgaaggaggaagacttaagatggcgcaacccataacggatcaggttggttttcttggagaggcctgcagggctgtacaggaattatctgcaagcagaaatttattggaaaagttccgcctggaagaaaaacgtctggacaaggaactggaagcagagagaaaggctgtgacagatgccatcagccttacggtgaagaaacggatcgaggaaattaacgacacctatgacaaagagattgccagggaacaggaccgcttaaagcgggtgagaggaaagcgtgaaaaggccaagacccagggcgtcaaggaacggatcgaagaggagacggcagagcttaaggaaaacaaccgggaattaatgctccagatgaagtctgtttttcagcaggaccgggttcctggtttttgcaaaaagggctggtattatgctctgtattttcccaggggattttctgagttttttgtgctgcttttgaacgtatttctgttctttctggtcattccctgcggggtttatctgctgcttcctgaaaaatccccgttctacttaatggggatctactttgctgccattttgtttttcggtgggatttacattctcatcaataactttaccaaggtgaaacaccagagcgcattgagaaaaggaaggtccatcagggatctgataaagaccaacaagagaaagatccgggtgatcatccgctccataaagcgggaccgtgacgaagccgtatataacttagaaaaatatgatgatgagattgccagaatcgaacaggatttagcagatattgcggataagaaaagggaagccttaaatacctttgacagggtgacacgaaccattctgtccgatgagatcgccggcaacagcagggaaaagatcgcaaagcttgagaatgactttgaagcggcggcggccaatgctaaggaggcagaagtcagggttaaggagcagaccttgtttattaacgacaattatgcgtcctatgttgggaaggaatttatggttccggagaggctggatgaactggctgatatgatccggatgggcaaggcttccactatcagtgaagcaataactctttataaaagtcttaaggagtaaggttaaggtgcaggaaatgggcatatatgtgctctcagcctgcacctgtttttttcgtaattttccccaggggtgtggtgaataattccataaacggcggcttataatagaacatggaaagtcaaataccccacagccggctatagggcatttgactcctgcagcattcgtcaaattcggagatacttgtatctctgctcttggctcattgcctgcagaaataaggacagcaaggcaggatattatgaaattatgggaaagaattgcgatccgcggaaaccgggacgttttttactacgatacaaggcagacttttgaggcagaggattttgcctccaggctttacgatatgatatgtgcggagcaggaaaacggaaaggtggccggggtgctgtttttatgcattggaaccgaccgttcaactggggacagcttagggccgcttatcggatacaagttaaaggaaagagggcttgaatatctggagatcctgggaactctggaacgtccggtccatgccatgaatctggagacttaccaggcaattttaaagcttcgttatccggatcatgtggtggtggcagttgacgcttctgtaggaagtatggaacacatcggctatgtgactttgggaaaaggcgcactaaagcccggccttggagtcagcaaggagcttcgggccgtgggggatatttttattaccgggatcgtaggcagctgtggaaattatgaccctctaatgctgcagagcatccgtctttccgttgtcatgagaatggctgactgcatcagctacagcatttatcttgtcgaaaagttatgggaaaataccgccccgctttgacacgattttcacccattgtatgctatgattcattggattaaaaagaatagcggggtgagccaatgggtgaattatataatccgttcccaaagctgccgaagaatatcaggcagattggggaaagggatcagattgtaaaactttatgtggaagattatgtaaatacttatttgaaacgtctgtatcctgcgggtggacaggaactgcgggttggtcttctcttaggcggcatggaattcaatgacggaacgccgtatatcttcattgacggagctatggaaatggaggatgtgacggaggccggccggagagtgatattttccgagatgtcatggaaaagagcctaccggaacatggagcagctttttccaaagaggtctattcagggctggtttatatgcggcaggcctggagatgatttgagccccatcaattattggaaacagcatatccagtattttggggaaccgaacaagctgatgtatttgtgcaatggaacagacggagaggagacaatttacataacatctgaggacgggttttacaagctgcagggatacagcattttctatgaacgaaatcagatgatgcaggactatatggtactgcgaaaagatgtaaaacgtatcgaaacagatacaaatgataaggtgatcgaggaattccgcaagcggatggacgagcataaggtggaagttacggaccggcatcagacggttgggctactccggggcatgtgtatggccatgtcagtcgtcatattagctggcggaattgttatgtttaacaactatgaacgaatgcgggatatggagagcgtgatcgcgtcggccattccggcaaaggcggaacagctcctgattgggaaaaagggtgaagaacagggaaacaagggcgaatccaaagtagttgtggaagaggccgagggaggcgtctatcccaccaccgcggtgagtaaggagaccatgtctgaaacattgcctgcacaatcccaggcggagacaatggctgagagcaaggcagcagagacgctgcctccggagacggaagcggcaacccaggcagcgacagaagcggcaacccagcctgccagccaggaaacagaggcagcagccaaggccagtccgcgtgtttatgtggtacaagagggagagactctttacgggatctgcatcgctcagtaccaaacggtgaacaaactgaaggaaatttgtgagcttaatgggctggacgatgaaaataagattgttgcgggccagaaattacttcttccatagaaaaatataatgcgtttcttcctgaaatgatgtatactacctatatatatgggcatttttgggagaaaagagcatgagtgacagggactctatgaacagagagattaagaagaaccagcttcggaggcagattgtttcatcttctcctcaagcgggcgaagacagccaggaggtcattaaaaaggctctcaccaaggtgaggaaaagaaaaatcaggatagctctggttctgtttttggtgcttttggcaggcggcataggggtatatgaatattttactctttatcagtatacccaatacggcgtagtctgggataagcagataaatgagggaagctatgttggatatcttagctttggctccaatgtgttaaaatacagcaaggacggcgcctcctatctggattcccaggggaaagaagtgtggatagaaagctatgagatgaaatctcccaaggcatgggtaaacgggaattatgcggccattgcggaccagcagggaaattccatctatatctttgacaaaacgggaaacacgggcatagcgactacggttcttcccattgtgaaggcgacggtgtcctcttacggagtggtggcagcgatcctggaggactcatcgtccaattatatttatttctttaagagggatggaagtgctctggatgtgaagattaaggcgctgttaggcggtgattccggttatcctgtggatatcagcttatcccccgacggaactcagctgataggagcttattcatatttgaaaaacgggacgttaaacggcagagtggcgttccacaattttgcggaaatcggcaagagtattccggacaggctggtaggcggttttgacgagccttatgacgcctctttggttgcacaggtccaatttcttgacaatacatactcctgcgcctttgcagataacagcgtatccttttactccacaaaaaatgaactctctccggagctgatccggcaggtggcagtggaggaggagataaagagtgtgttctattcggagaaatatgtagggcttattgtggacaatggggaaggagaaaatccttaccggctggatatatacaagcccagtggaaatctggtgtttaccaaaggtttccaatatcagtacacccatgctgatattgacggggaccacgtaattttgtataatgaagattcttgcagagtctataatatgtcaggaaggcttaaatttgccgggacatttgattttccgatatctaagatccgaaacggcaggttcccaaatactctgatcgtaaccggcccccaaaacatgaaagaaataagattacaaataggaggacaataccaatgagcaacatccataccatgtcagtcaatgcaatccgtgtcctatctgcggatgccatccaaaaagcgaattccggtcatccgggacttccattaggctgtgcttctgcagcttatgaattatgggcgaaccatatgaaccacaatccggcagatccagactggaccaacagggaccgctttgtcttatcaggaggccatggttccatgcttttgtattccctgcttcatttattcggctatgggaatttatcaaaagaggatttgatgaatttccgccagcatggctccaagactcccggacatccggagtacggtcatacaatcggtgtggaagcaaccacaggacctttaggtgcaggtatgggtatggcagttggaatggccattgccgagaaacatctgtcatccgtattcaacaaagagaattatccggttgttgaccactacacctatgcgctgggcggggatggctgtatgatggaaggcatttcctccgaggttttttccctggcaggcacccttggtcttgggaaattgatcgttttatatgattcaaaccagatttccattgaaggaagcactgagattgcatttaccgaggatgtgcaaaagcgcatggaagccttccatttccagaccattaccgttgaggacggaaatgacttggaagcaatcggacgggccattgaggaagcgaaagcagatacagagcatccttccttcattaccatcaaaacccagatcggctacggctgtcctgcaaagcaggggaaagccagcgcccacggagagcctttgggtgctgataatgtgaccgctttaaaggaaaacttaggctggccttccacagagccgttctacgttccggaagaggtgtacagccattatcgtcagatcgcagaggaaaaagcggagacagaagcagcatggaatgtgatgtttgccgcatattgccaggaatatccagacatggaagatctttggaatgcataccatgatccggatgcaggagaaaaggccattgaaaaatgcgaagacttctggaagcggtctgaaaaggcagatgccaccaggaatttatccggacaggtattaaaccggataaagacttatatgcccaacttaatcggaggttctgcggacctggctccttccaataagaccaacatgaccgacatgggtgatttttcaaggacagacggcagcggccgcaatctgcactttggcgtcagagagcttggtatgacggcaatcggaaacggaatgatgcttcacggcggtctccgcacctatgtggcaaccttcttcgtattcagcgattatacaaaaccaatggcacgcttatccgcattaatgggcgttcccctgacctatatattcactcatgacagcatcggtgtaggagaagacggacctacccatgaacccattgagcagcttgccatgttaagggcaatgccgaatttccatgtgttccgtccctgcgatgagacagagacagaagcagcatggtattctgcactgacctctaagaaaactcctaccgcccttgtgctcacaaggcagaacttaactccaatgccgggaagcagcaaagaggccttaaagggtggctatgtgattgacgattgcgaaggcacccccgaaatcattctcatggccagcggttccgaggtggaactggcagtcaaggcgaaaacccttcttgccgataaaaaggtacgagtggtttccatgccctgtatggatttatttgaggagcagacagaggagtataaggaatccgttcttcccaaggcagtccgcaagcgcgtggcagtagaagcattaagcgatttcggctggggcaaatacgttggccttgacggcacatatgtgaccatgaccggctttggcgccagcggcccggcaaatcttttatttgaacatttcggattcgcggcagaacgcgtagcagaggctgcaaaatccatctaagcaatgagcagtgagaaataggacaggagaaaattttcgttgtgcttgcacataagaaaatcttctcgtggcctatttcatagggcgaatgcccgtgagctggcaaaacctacggttttgccagctccactgcggacttgcgttacgacagttaaaaaggagtgtatacaaaatgggaatgaaatgtgttggcgttgatgtaggaggtacatccgtaaagatcggaatatttgaagtgacgggggaactcatccagaagtgggaggtgcccaccagaaaggaagaaggcgggaaatatatccttgaggacaccgccgcttccatactgaaaaccttagaagagcttaatattcccttagatgaagtaaaaggggtaggcttaggagttcccgggccagtcatgcccagcggatatgtggaggtctgtgtgaacttaggctggcgtgacatgtatccggaaaggacactgagtgaaaaacttcacggcttgcccgtaagaagcggcaatgatgcaaatgtggcagcccttggcgagatgtggcagggaggcggaaaaggctatgatgatattgtcatggtcactctgggcacaggagtcggcggaggcgtaatcattgatcaaagaatcgttgccggaaagcatggcctggccggtgagatcggacatatgcatatccgtgacgatgaaacggaaagctgcaactgcggaggcgtgggctgtgtggaacagatcgccagcgcaacaggcattgcaagagaggccagaagaaaaatggctgcaacggataccccctccgctctcagaacatttggcgacaacgtaacggcaaaggatgttctggatgcagcaaaggaaggggatgccctggcttgtgaggtcatggaagtagtaggccattatcttggccttgccctggctcagatttccatggtaacagaccctgaggtctttgttatcggaggcggtgtatcaaaagcaggagccttcctgattgacaacctctttaagcattatgataaatatactcccatttctaaaaataagagcgggatcgttcttgcgaagctgggaaatgacgcaggaatctatggtgcggccaggctgattctggattaaataaaagggcggattcttaagaatccacccttttacttataaagctgttcagctgatcatccaatttcaaacaccaatttaaccggtattctgtccgtaagctcttctaccggcaaagcgccccggcaatctccgcagccttgttaaagtcttcttcctccgggttccaaaggcatttggcctcctcctccaccacagagaatccggcttcagtcaaccgttcccgaaggacttttgttccctctccgctccatccgtagcatccgaacactgccgcctttttccccttatatttcaattccttcaggaaatcaagccatccccccacagaagaaaggatgttccctcccacggttggagatccaagggcaatcgcttttgatttaaacacttctgtcatgatatcgttcttatttgtcttggaaatgttataaatcttcaccctggtatccggtgaaatccgcgcgatttcggcgctgatcttatgggccagctgcttggttccatcccacatggtatcataaacaacagtgatctgatcctcttgatagttctgggaccattcataatatttttccacgatctgtaacggattttccctccagatggagccatggctggtagcgatgatatcgatgggaaggttcagtccctgtatttcttcaattttctttttcacaagaggagaaaacggagtcagaatattagcgtaatacttgatggcctcttcccaaagcctgcactggtcggccttgtcattaaacaattcctccacggcataatgctgtccaaaggcatcgttggaaaagaggatattgtctcctgttaaataagtggccatgctgtccggccagtgaagcattttcatttccacaaaaaccaactttttcccattgccgatgtcaatggaatcccctgttttcaccacctggtaattccattccggatggtgatactgtcctgtaatggatttcaccccgtttgcggtgcagtagatgggggtgccaggtatcttctccattaatgcgggaagagaaccgctgtgatccacctctccgtgattggcaacaataaaatcaatttcctttaagtcgatctctttttccagattgtcgatgaactccgtggaatgaggcttccagaccgtgtcaatgaggaccgttttttcttcctttattaaataggcattctgacttgagccgtggttaatggaataatctgccccatggaaggattccagctcccagtccatgaatcccacccagtaaacattatttttcacaagttttttcattgttccattcctccttcatattttggaaacagcagtgagttttctgtaaatatatgaatatacacgtccttaaccagttcctccagcttctgaaagaccatgctgtaagaagagcagccgtcttccggaggggtaaaatcattggtgcagactgtgatctcttttatcaggtttccggctccttcatgctcatcctccagctcctttacatatccggcgcttttatcccatgtaaagctctctttcatatagggaaatataagcctttcttccttggcaaaatgttcctgcagctcttttctcaagtctgaaaaaagtccgtgtaagggaaccagctgctcctgatgatgttcgtaatgaaccagcaggaccttgttgatcagctcatcgatttctgccaggaggattctctcctttgaatgatgggtgtcgatgatataatcgatcagctccgggacatccatttccatcagccgttccactgccagcacctgtcccttatttgatttctggggtttattcacaagctttttattcagcagttcaataaagctttttgattcgattcccagcccttgtaaggcagcttctaaatgatctttcccgccgcagcaataatcaatatgaaaatcattgaaaatttcaactgcttccggataggctttcaccacatcggttattttcatgttacctgtaatcataattctcctcctcttacctgaattctttgccttttctaaaacaattgctctgtctgtaaggctagtataaccgggaaagagaaggaaaaatgtgatttgaatcattatttgaaaactttttaatcaatttattaattttcacttttaaaggcatctcttaaaatatccttgtttcgaacgcggattctgcggtttccttccagctcgatcgcgccgtccctgcgcagttcccccagctttctgctgatggtttctcttctgacattgataaaggcagatatatcatccctggtcaattcaatggtttcccccttgatccggctgcttctgaataatagaaaaccggcgacccgtgccttggcatcgtttacggataatagctgtaccagttcatttgccgccgacagcttctgccctactacgtttaataatttaactccgatttcaggtctttttaatatcagcgcctgaatatctgacagggaaatgagacatactccgcattcccccagggcaacggcatttgattcaaagacttttccgccgaatatattctgctccccgtaaatatcgccttctaccaggatatcaagtacatattcctttccttccagggaatagcggttgattttggcttttccgtaacggatgaccagaattttatccgccggatcatactcgtggaaaaccgtttctcctcttttaaaatccagatgccgggcgttagaaacaagttctttctgttcttctaaggagaggggctcaaaaagagggatctttgaggtgcataatttgctgcagtggttacatgtaagctccattcctgtctcctttcgggggtttgactgttttatggataattgtattatatcaaacagcaggaagatggcaagaggggtcttatttctgcagtttttttgtttctggcaaaggtccggccgccgggattatgaaatatggtaccggatagtcctgtaaaaaggattatcaggggtggtaagccggtaattgccgggcagcaagtgcatcacatcgggaatgtcctgtgcttccagtgcaacggcacaggaggggaaagaggaggctccgccggacaaggctattccatggggtaaaaacccgcctgagtataagacaagggcaggtgcatccgtcatcattttcaaggtccggccggtcttcttatcccgcaggatacaggcccgtttaagctcgcctggccgctttgcaaaccgcagaggccggaaggtctggtttttgttaagaatataagcgttattatatccgcgtccaatggaaagctgctccttacaggctagcgcttttgcagaccggatccgggaaagaagctgctttgaggaacggaaatcaaagacagtgtctgctgcgggaatgatatctgcaggaagatggtccttattattgatgcatacgttattggcaaaaacctggatctcctgttccaaaccggagacagaaaagtccccggaaagattccagtaggtgtggttggacatattgatataagttgaaacgtctgtcacggcagtgtattctatggtaagccagttggtgtcctccagggtatacttagcgtggtaggttctgttgcccggatagccgtcaaggccgtctggctggctggcggacagaaggatagaagccgattccaggccggatgtcacagatgtcacctcccagagccgggaagataaattcttcactcctccgtggagctggttttgcccgtcgttttttgaaagctggtatagctgggttcccacaggaagcagggcgttcccaattcttccggcattgggcccaagggtggctcctgcatagtaaatacagctttcgtactgccccatatcctcaaagcctaaggtgaggggctgctccctgccggtttcctcccttatggcaactttttgaatggcagcgcccagcgccgttacggaaaccgtcatgccccggccggtggtcatatcataaaccgtataaacagttcccttctgattccgtaattctctggtcttgattttcataagcatgtcctccatttaaagccagtataaggatttgccgcgggaaggagaagtgcaaacattaagaagagcaatttttcaaaatgacagagcaagagaaagcaacggcagtctgaaaattaacatccctgcagaaaaaacaggtacgaagggaggactctgaggccagtttgcggtaaaaaagaaaatttatggcaaatttttgaactggcgatggctcttttattataatggcaggatagagggtataatatgagagcaatttttaacaatgatagagcaaacctgcataatgatggattttgattaaatgatataattagcttattaaaacgtaaagctggaataaaaaaggaggggttaggcatggggagtgtattggaattccagaacatatccaaatattttcccggagtaaaggcgttggaccaggtatcctttcaggcgcattccggagaggttctggcgtttttaggggaaaacggggcaggcaagtccactctgttaaaggtgcttaatggggattaccagcctaccgggggaaaatatcttctggatggggtggaaaagcactttcagtcccctcatgaggccattgaggaagggatttccgtcatataccaggagcggcagatccttctggaattgtctgtggcggaaaacatttatctggggagaatgcctgtaaacaggctggggtttattgatacccggaaagcaaatgaaatgacggagaaaatcatagaagattttggtcttccaatcagtcctaccgtaaaggtgaaggatttaagcatcgcctatcagcaaatggtggaaattatgaaggcctattccagggaaaacttaaaggtgatctgctttgacgagcccacagcctccctgtcggactcggagattgaatccctgtttaagatcataggaaaactgaaggaagaaggaaagatcatcatttatgtgtcccaccgcatggacgagcttcggagaattacggataaggctgtaattttcaaggacgggcgctacgtggcaacagtggaaacgggaaaggtgccggaagcggagctgatccgtatgatggttggccgggatctgggtgatatttacagaaacttagacaggaacaaggtgattggtgatgtgcttctggaggtgaaaaatttatcttcagactatgtaaaagagaattcctttgtgctgcggaagggagaagtgctgggattttccggccttgtaggggcgggaaggaccgagcttatgcgtgccatcatcggagcagatgaggcgaaaagcggagagatttatctggaagggaagaaaatacacaaccgttctccccacgaagccatggagcagggaatcgtcctggtgccggaggaccggaagctccaggggatcctttccaatttaagcgtcagcgacaacatgaacattgcaatgctggataccaattccaataagctggggtttgtcagccgggaaaaggaagagaaactggcccttgacggtatccgggattttaagatcaagaccccgtctccagacaaaaaaattgtggagctttccggaggaaaccagcagaagtgcattgtggcccgctggatcagcacgaatccgaaggtgctcatcctggatgagcctacaaagggaattgacgtaggagcaaaatcggaattttatcatatgatctgtaaatttgccaaggaagggctgggaatcattctgatatcctccgagcttcctgaggtgatcggcctttcggaccggatcatagtcatgaaatcattgagaatcacaggagaaatagcggcatcggaagcaacggaaagcaagcttctgagcctgggtatgattggggaggtacaggaataatgggaacaaataagaaaagcagaatcaggataaacggagacaagatcgtactgctggcggcaattgcagtggtattcgggctttttacctctctgaacaggaactttctttcggttacgaatttaatcaatattctggtagcggcttcccttgtggggctggtggctgtgggacatacatatttaatcattgcagggcagaatgatttgtcccccggctctgtggcggccttttccggtgttgtggcggccctgcttgtggggaagggagttcctttcggcgcagcagtgcttctgactattgccggaggcgtcctcatcggaattttcaatgcctttatggtaaaccggattcatctggaggcctttattgcaactctggtgacccagtccattatcaggggctttgcctatatcatatgcggcggaaagccggtttccatcagcaataagacctttctcatcctgggaaaagccaggataatgaacattcccctttccgtatggatcatggtgatctgcattatcattttcggcatcatcctgtccaaaaccaaattcggaagaagtgtttatgccattggcggcagcatggaagcagccagacttgccggattaaatcccaaaaggatcatcaccacctgctatgtgatgatgggagtcctctgctccatcggcgggatcatttttgcggcccgcatgaattccggccagccggcggccaatgtgaacctggaatttgacgcaattacagcggttattctgggcggcgtatcctttatcggaggagtgggaaatatgggggaaccatccttggaattatcttgatccagtcttttaacacgggtcttaccatggtaaacgttcccagcttctggcagtttgtggcaaagggaggccttctcttattcgccttggcaacggactatttgagaaagcagaagagagagcgggatttactggcagcatccatgaaaaatttatagcgtccacggaaaaccggcaggttttcttaagatagagcaaaaactaaaacaggagggtttcaaatcatgaaaaaaacagcagcaattattttggcggcagcaatggcaatggggttgacagcctgcagcggattttccgatgaaaaggcggaggcaaccacaacagcgggtacggcagagacaacggcaggcggtacccagacagaagaaaaaacccaggctcaggcagagggaaagggtgttgtttacgggatttacaaggctggggatcagacctggttcattgacgaaggagcagcggctcagaaggcagtggaagaaaagggcgatgaatttatctatgtggatgcaaagatgagtccggaagaatacttaaaggcaattgacaatgccattgccaataaagcaaagggaatcgttacctgcatcccggaccagaccatgtcccaggcggtggttgataaatgcgaggaagcaggaattcctattgtagcagccgatgacgcgcttcagacagaggcgggagaaaagatcgctccatgggtgggcattaacgcttatgtgatcggagaggccaacggccagtggctggcggattatgccaatgagaataatctggcaggggacccggaatgcggactgctgattctgaccatggataccgtttcctcctgtgttcccagggcggaaggcgaatacgataagtttacggaagtaagtcctgattttgcaaaagagcggatctataaggccgattatgacggaaccacggacaaaggaaatgtggcagctacctcagtgattaccgctcatccggaaatcaagaaatggctggtaaccggagccaatgaggaaggcaccatcggtgcggtacgcgccctggagagtgcaggtctggatgccgatgcaacagtagtgggcctgggagcttatatggcaaaggatgaatggaacaacaagggagctgacgggacttgtatgaaagcagcggcctacttttcttctgattccgttggagcaggttcagtcaatgttttatacgatgtgatcagcggaaaagaggttccaaaggagacagccgtagatgcggtgatcgttacccccgaaaattacaaggaagtaatgggcaaagcagcggaataaaccgattgcctggtgatgaaaaaaagcagcctctgcaatgcaggggcgcttttttcagttcctgatagaaaaacggtattcggaaggcgtgattcccgtcacctttttaaatgtggtgcaaaagctgctttcactggtaaagcctgtgctgaagcagatgtccttgatggagatgtccagggactttaaaaggaacttggcattgttgactctggcagcgatcacatattcgtgaggtgagaatccggattcctttttaaacagccggctgaaataaaaagggcttaaggaagcctggtccgccaaatccttcagggtaagaggatcagtcaaatgttcgttgatgtaggcaatggtgtcctcaatgatgctggaagaaacgttttctgaatgctcaaagtccctgttgaccaaaagctccgttagaatattaacaatgtaattgttcagccaggcctctttgacggaaatacattcccgaaactgcagataaattttgtgcagatatttttccagacggtaggtatccctcagggaaatgacaggagggccgccatccaggattgcatcataatatcctgccgcacctatgccgtcaaaatggagccattccgcttcccagcccgttgttgtccagtaggcatgaggctcaaagcagtttaacatcactacctgccctccgcctgcatgatagacccgtccacctgtttccacctggcattctcctcttcggataaacatgatgaggaagctgtcataggaattccgatgaagggaatagccgggttcgtaccggaaaagtcccatgttgatgggatataagaagattttttttgcctgggcgctgggcgtgtaaacataataatctgaccctgagatgaccccccgttctgtagacagcatatataggccctcctttctttttatgaaaccattatagagaaaaaacggtgattcgtcaattgtattagagcaatttttataaactagtaagcaactaaaggtaatgaaaaccatgataaaagattatatagtataggcaagaacttaaaaggaggtctaagaatggaagcagtaaaaatatgggaggaatccatcgtcattcccacttatgaggtgggggaagcagataaaaacccgatgtttctggaaagccgtgtttatcagggaagctccggaaagatttatccttatcctactgtcgagaagatccatgataccaggacggacaaaacctatcaggcggtctggctggaaaatgaatacttaaaggtaatgatactcccggagcttggcggaaggatccaacgggcctttgacaaaaccaatcaatatgatttcgtttattataaccacgttataaagcctgccctggtaggactctgcggcccctggatcagcggcggaatcgaatttaactggccccagcaccaccggccgaccacctattcccctgtggattatatgttgctggaacatgaggatggttccaaaacctgccgggtctgtgatgtggatcagatgtatggaaccaaggggaggccagcttcaccctgtatcccggaaaggcttatatagagataaagggccagctttacaaccccacgccaatgccccagacctttttatggtgggccaacccggcggtcccggtcaacgatcatacccagtctgtttttcctccggatgtccacgccgtcatggatcatggaaaacgggatgtatcccgtttccccattgcaacgggagtttattataagcatgactacagcgaaggcgtagatatttcccgctataagaacattccggttcccacctcctacatggcggaaaagagtgagtttaactttgtaggaggctatgattaccaggtgagggcaggaatccttcatgtggccgaccatcacatttcccctggcaagaaacagtggacctggggctgcggcgatttcggaaaggcctgggaccggaatttaaccgatgaggatggcccctacattgagctgatgaccggtgtttacacagataaccagccggattttacctggttaaagcctatggaggaaaaaacctttacccagtatttcatgccttataaagccgttggtcccgtgaaaaacgcctccattcacgccgtcataaacttagagacaagggaaaatgagatccatgttgccgcatacggaacccagaagtaccctgatgcacggatcctgctgacttacggcacggaaacgctgttagatgaaaccacccttctttctccggttcatatttatgaaaagacgctgcatacggggtggaggatgagacaaggctgactcttaaagtcctttccggagaaagggagctggtttcctatactcctttaaagaaggagattccaaagcttcccgacccggccaaagcggccgatgatccggaaaagatcatgacaaatgaagaattgtatctgactgggcttcacattgagcagtaccgtcacgccacttataagccggatccttattacatagaaggcttaaaaagggatccaggggatattcgcatcaataacgcctacggctccctgctcatgcgcagaggctgttttaaggaaggagaggagcattttaggaaggcgctgaaacgggcagtctggaaaaatcccaacccttacgattccgagccctactacaatctgggcctggcgctttggtatcagggaaagattgaagaagcttttgaagccttctataaggccacatggtcggttgagcagcaggaaatgggcttttattatctttcctgcatcgaatccatgagaggtaattatgaaagcgccctggaattcgcagataagggactggtaaggaatactcataatgtaaaggccagagccttaaaagcctatcttttgcgcaggcttggcagaacggaagaggccaaagccctcattgcaaggaatttagaggtggatccctttgattatgtatcatggctggaatcctcatatctggagccggaccgccaggaagaaatcagggcaaagaccagccggctggccagaggctttcatgaaaattacttaatggcagccaggcattatggggagttcggcgcatatgaagctgctgtagagaccctggaccagtgttcccggaaatggcccatgctctattactataaggccttttatcaggatcttatgggaatagacggggcagaagccttaaagcaggccgaaggctgcaccacagattactgcttccccaataagctggaggacattttggtgttaaagtttgctgcaaaaaagaacccggaaggagccaatgcctattattatctgggaaatttattttacgacaagcttcagtaccgtaccgccctttcttactgggagcattctgcccggctgaatccccggtttccaactgtgtggagaaatttatcactggcctattacaacaaggaaaaggacagggaaagtgccggaaaggccatggaaaaagcctatagcttaaacccggccgatgccagagtattcctggaactggaccagctttacaaaaagctggatatgccggtatgggaacgtctgaaaagatatgaagccgcaagagatgtatttatgaagcgggacgacttaatgattgaatatgcaacccttttaaatcttctgggccgttacaatgaggcttatgaattcattatgaaccacaaattccatccgtgggaaggcggggaaggaaaggtaaccgcccagtatgtggtttcccttgtggagctggcccggcaggccatggaaacaaaggaatgggcagggcggaagaatacttaacaaaagccctgaaatatccggaaaatctgggagaagggaagctggaaggaacaaaggacaatcatatcaattattatctgggtgtggtcatggagaatctgggaaaggcggaggaagcaacggcctactatgaagcggccggcgtgggaacggatgaaccggcaggcatgatgtattacaatgaccagcctgcggatatgatctattaccaggggctggcaaaggaaaagctgggaaaaccggtggaggccagagccagattctataagctgctggactatggggagcagcatatgtctgacagcatgaagatcgaatattttgccgtatccctgcctgatttcctgatttatgaagaagacctgaataagaagaataaggcgcattgcagctatcttacagggcttgggaaaatggggcttggagatacagaaggggcaaaggcggctttcatggagaccataaggctggataacgctcatttaaacgcaatcaggtatttgaatatgatataagccttggccataacaatataaaagtaaaagcggtccctgtgattttgcaggggccgttttatcaaaggcagaggtttcctttcctgctttcgtttttggtttcatactgatacgaagaaagtgcgtcaccatgtctggaaacgcacttttttcgtattctccatcttcaagaaccagttttaccgcagctatttcattttccttgtaataagctttgcaagctcgccgcccagggtaggaactaccgcaaagcccagtgcctcgcttaactgtgtgagggtaagaggcgctgtactaaaaattgtatttaaaagcggcacataaaccacaacaactaaaagtgcaaaggaagcgattacacatttattcaggaaggagtttgacaaaagccggattccgaatatggacctcttttcgcttctgtttgagtaggcacggaagagctcacctaaaataagggctacaaagcacatggtacgggcaatggtttccccgttttcgacgcctctgtagtttacatgaccgatatagaatgcggtcaaagcgccgatgcccaggaaaaggctctgcagggtaactgttacacgcatcttcttatcaataatggattcgttgggatctcttggcttctggtccataatgccaggttccttttcctccattcccagggcaaaggccggaaaggcatcagtgataaggttgatggaaagcaagtgaatgggcattaacggcataggcaggttaaagagcatggctaaaaatataagaagtatctcaccgatgttgcaggaaagaaggtaacccaccacctttctgatgttgttatagatggttcttccttcctcaacagctttaacaatgcttacaaagttgtcgtccgtaaggatcatatcggctgcttccttggaaacatccgttccggtaattcccatggcaacgccgatatcagctcttttaaggcttggcgcatcgtttacgccgtcccctgtcatggcaacgatctccccgtttgctttgcatgcggtcacaagccgtaccttgtgctccggtgaaacgcgggcaaatacgttaacggttttgaccttttctctcagttcttcatcggacagaagctgtatttcagctccttccaaagcctcttgtccaggggacatgattcccagatctgcagcaatggcgctggctgtaatcttatggtctcctgtgatcatcttcacgcggattccggctctcctgcattcgtcgaccgccggctttacttcttctctcggcggatcaatcatgcacatgagacccaggtaggtaagagagtgttcctgactgtcaaagtcatcaagagtttccaatgtcttgttggccacgcccagcacgcgcaaagcgctttttgcaaatccggaattggcttccaggatttttttccggtcagcctccgtaatttccgaaacctcactatctttataaatgcgggtgcaccgttttaaaatttcatccggagcgccctttgtataaatggtcagttctccgtctttttcatggaatgtggacataagctttctgtcggaatcaaagggaatttcctgaacccgccggtattcttcgtttagccggtctttgcttaggcctgttttttctcccaaaaccagcatggcgccttccgtaggatctccgatgatctggcttttttctatatcataggttgcgtcattgcacagtacagcgccctttataagttccataatgttggatgttaacctgccgccttcttctacggtgacggagccttccctgctgtagcctgtaccggtcacatcataagctctttcatagtcaaataccttgactacggtcattttattctgagtaagagtgcctgttttatctgagcaaatgaccgttgtgcttcccagagtttccacggcggaaagcttctttatgatggcgtgggattttaccatctgctgcatgcccattgcaaggattacggtaactaccaccgtaagtccttccggtatggcggccacagcaagagaaacggaaaccatgaagatttccataagcttatccccctggatcagtcccaggataaaaatcatggcgcatacggcaatgcagacaatacccaaaaccttgcccaggctgtcaagcttcttttgaagcggggttgtctcctcttcggattcattgagcatggctgcaatattgcccatttgggtttccatgccggttgcggatacgatgcccttgcctcttccataggtgaccacagttcccataaaggcagaattgacacggtctcccaggggcgcatcctcaggaaggatgctctcacagttcttttccacgggaactgattcaccggtaagagccgcttcatcgatttttaagttaaagctttccactagccttacgtccgccggaatataatctcctgcgtcaaggatcaccacatcgcccaataccagttcctcggaaggagtctttacgatgtttccgctgcggatcacctttgcctgagggctggacatttccttaagggctttcagtgcactgcttgcctttgtttcctggttcacaccgataatagcgttgatgattacgatggcaatgattacgaggctgtcaaaaaatccttcgtcctcaacaattcccacgaccatggaaacgatggccgctataatcaggatgatcacaagaaaatccttgaattgttcagcaaacagctgcagcagggtcctttccgttgctccctgcaaccggttgtaaccgttttcctcaagccgtttttttgcctcctgcggggataatccctgaagggggtcagtttttagctcactgactgtttccggaatagccttgttataaaattttttcatacataatcctccatttaaatttgctatgtagcgccttgttttctggcggaccgcctggaagaaagtgaaacaatatattcatgttaagtctttttgatgattctgtcaataaagtcaaggcgggtattataattgtgtcagtataattgtattatttcataatttatgggatttattctgaacatgaaaggttatggagatagcatgaaaggcagaacgtcataataccctgcttgtgcctttatgcccaaagagcaagggcagagaagatggagtttgtaatccggacaaaaagttggagcaagcttgctgttgaagcggcggatgttttagggaagtaaatgagaggaagggatgtttatatgacatcctttcctcctgtcctcttatttacaatttactaaattatgatataatgggaatacttaacaaagaaaaacctcgtgaaatgaggagaccccggttgacaggcaaccggggcaattatgaaaaatctatgtgcaatttgacgatttaatcaatttgactcatatattttctatgtatttagtataaaaaatatatgtgaacggaatatgaacggcctgtaaacacattatgaaaaaagggaggaaagtatgggagaaacttataagaacagaaagaccatcgtaataggacataaaaatccggacacagattccatctgttctgccatctgttatgcaaatttaaaaagtgcactgaccggagaggaatatcagccgggcagggcgggccacgtcaatgaagaaacacaattcgtgctccattactttggtgtggaagctccggagcttgtggaaaatgtgaagacccaggtccgtgacattgatatccgtaaaacaaagggagtaaagaaaaatttatccttaaaaaaggcctggaacctgatgcaggaagccaatgtggtcaccattccggcagtgactgaggacgggatgctggaagggctgatcacggtaggcgatgttgcaagatcctacatgaacgtgtatgacagcagcattttatcaaaggcaaatacccaatatgaaaatatcgtggaaaccctggaaggggctatggtagtgggcggaaagaatgaatatttcaaccatggcaaggtgctgatagcggcggcaaatccggatatgatggaatattacatttccaagggcgatcttgtgatcctgggaaaccgctatgagtcccagctttgcgccattgagatggaggcggcctgtatcattgtatgtgagggcgcggcggtatccatgaccattaaaaagctggcccaggaacggggctgtacagtcatgaccacaccttatgatacttatacggcagcccgtctggtgaaccagagcattcccataagctattttatgaccaccgaaggcctgatttcctttgaggtggatgattatattgatgacataaaagatgtgatggcaagcaaacgccacagggattttcctattcttgataaggacgggaagtacatgggaatgatctcccgccggaacttgctgggcgcaaagggaaagcgcctgatcctggtggaccataatgagaaaacccaggcagtggaaggcatgtcaagtgcggagatcctggagatcatcgatcaccacaggcttggaaccgtggaaaccattgccccggtatttttccgcaaccagccggtaggatgtacggccaccatcgtataccagatgtatcaggaaaacaaggtggcaattgaaccgaagatcgcgggtctgctgtgcagcgccattatctccgataccctcttattccgttctcccacctgtacggagtcagacaaacaggcggcccttacccttgcggatattgctggcattgaggtggaaaaatacgcttcttccatgtttgcggcaggaagcaatttaaggggaaagaccgatgcagaaatcttttatcaggattttaagaaattcacggttgggaaggtgtcctttggagtcggacagatcagctccttaaatgccaaggaactggaggagttaaaagaccggatgctgccttacatgaaaaaatcgagagaagaacatggcatggatatgatgttctttatgcttaccaacattctgacggaatccaccgtactgctgtgcgagggttcgggagcaaaacagctggttataggggccttccgggccgaggaagaggaatccaaggcagaagatcatgttgtaagccttcccggtgttgtatccagaaaaaaacagctgatacccggcattatgctggcagttcaggaatagggggctgccggatcgatgaagaaacaggaaaccagtgaaaataaaaaagaaatgaaacgctccagggtcacctggaagccgggaaacatgctatatccggttccagcggtcatggtgagctgccagagggaaggggaaaacccgaatatcattactgtggcatgggcagggaccatatgctcttccccggccatgctgtccatatccatccgcccggagcgccattcctatgggatcataaaggaaaccagagagtttgttgtaaacctggtaacaaaggatctggtacgggctgccgattactgcggagtgaagtcaggcagggaggtggataaatttgcggaaatgaagctgactccctgttctcaggaacatatcaaagcacctggaatagaggaaagcccggtgaatttagcctgccgggtggtggagatcaaggctttgggaagccatgacctgtttttggcagaggtggttggtgtgaccgtagacagccggtacatggatgaaaagggaaaattccgtctcaatgaggcaggacttatatcttattcccacggggaatactttgaattggggaaaaagcttggaagtttcggctattctgtgaaaaaagcaggaaaaaagccgtcaggcaggaggaaaaacaaatgatgagtaagcttgataacattacactgatcggcatgccggcttccggcaagagtacggtgggtgttctgctggcaaaacgccttggatattcctttgtggatgtggacattgtgattcaggagcaggaggggcgtctgttaaaggaaatcatcgaggcggaaggtcaggaaggcttcatggctgtagaaaacaggatcaatgccggtctttcggtccaccacagcgtcattgctccgggcggaagcgtgatttacggaaaagaggctatggagcatttaaaagagatcagcacagtggtttatttaaagcttagctatgaaagtgtggaagaaaggcttgggaatctggtagaccgtggcgtcgtgttaaaggatgggatgaccttaagggatttatatgaggaacgggtcccctattatgagaaatatgcggacataaccattgatgaaaacggccttgatgccggaaagacggtggacatgctcagagctgtcatggaggagaggtttggcctgaaaacatgatggcagcctgtgccaaaaaaggaaagagtatttgtgacaaaaagtcagccttgattggttttaataaccattcaaggctgaccttttttatacactgtttcacagaaaagccatattacggcagtcccctctgtttagccctttaattggaacctgtccattaagagcttcagcatctgggcctgtccggccatttcctggctggcagcagcactttcttccgatgtggcggaattggtctggatcacgctggatatctggtcaattccctgggttacctgggcgactgcaagggcctgatcctcggaggcggtggatatctgatatactaaatccgccgccattttggaggaaaggacaatgcggtccatggattgtgcagtctcctttgcgatgtgatttcctgcatcaatggaagataaggcccgttcaatcaatacggccgtgttcttggaagcttcctggctcttattggcaagattccgtacttcatcagccacaactgcaaagccctttcctgcctctcctgctcttgccgcttccacggcagcattaagggccagaatgttggtctggaaggcaatgtcttctatggttttaatgacctttccgatttctgatgatgcactgctgatgttttccatggcattggtcagttcctgcatctgcgtttttccgaattccagttcttctgcggtattattcacctgcttgttggtttcctttgcattttccgcgttctggtttatgttgttggatatatcattgatggtagcagccagctcttcaatggaagaggcctgctcagtcgcaccctggcttaaggcctgggcactgcttgccacctgatcggcaccggaagccacctggtcagaagactgggttatttttgccatgacatcatttaaggagtccgtaagattctgtatggagatctgaacaaaacggaattcccctttaaattcttccgattcatgaggaatgtcaaaatctccctgggccatgcggcctgtagtagaggagatataatccatataataggataaacgccccatcatcgtcctcatgctgtcggcaagatgtcccagttcatccgctgaactgtattccagccggcattttaaatctccttgggccattcggtctgcaacatgtctcagctcatcaatgggacgggtgattccccttgtaatcacgattgcgatgattacggatgtaacgatggaaataaagataatggcccccataatcccaatgaatatggaagtctggcgggagagctgggcagattttatgtcaccggctgttgacttatgggcagattttatgtcaccgacttatccgcagcatggtattgatcgtatcagcgatttccgcagcaaggggagcagcgtagctgcggaaaaaggccatggactcctgagacgattttgacgcaagctcaatggtctggctgcggatatcctcataggatttcattttctccaaaagctggctgtaaagctctttttctgaggcagtcttcatccttgcctgtacaagctgcattttctcgtttataacgtcgatctgtttgtttaaattttccttctgcttggcggtttcagcagcatcttccgaaaaaattatgtataagactgttgcccggtgagcctgaaacgcctgacccaggcttccgatatcgccctgggcaaatccataatcctgaagctcggcatgatattccttattaacagtccggatgagcaggatcccgatggttccggccagacctgaaaatagtacaacgatgagaaatgcagcaagcagccggttttttacctttagtttttttaacatagaatttcctccctgggattaaagtttatattgccgtaaaatgtttgtttccatgaacttctggataattgtcaaatttggtattttattactttattatataatactcaaatcctttatgaaattccaaaatatggattcactaataattatagttatttttcctaatttagtcaatatggtagatgattccgttgaaaattcccttgaaaggggaataagaagggggaggcgggtggttgaacggtcccagggaagcaatatttttccagcattattatgttcttcccatccaccaatcaccttgccgacaaaggttgacataattttcaccaacgtatattataagcatactttaactttataagctgaaattgattatggcggaaacgggtgctgagatgaatcagacggaaaaacacagcgttgtactgatcccttcacttgaacctgatgacagacttccggtttatgtaaggaagctgggagagtacggattatctcatattgtgatcgtggacgacggttccggaaatgattaccaggatattttcaaagagttggaggagggcggctgcactgtgctccggcataaggtaaacatgggaaagggacttgcccttaagacgggatacaggcatattaaggaacatgtcccaggttatatgtgtattataactgcggattccgacggacagcatgccccggaggatgtgtataagctggcaaaggaagctgagctccatccccatgcattgatactgggagtgagggactttaaaaaggctggaataccggttaagtccctcattggaaaccggatcacttccgcagtatttgctgggctgtacggaaaataccttcctgatacccagacagggttaagggcctttggctccagccttaccgataaaatgaccggcataaaaggagaagggtttgagtatgagactcaggttctggtcacctgtatccgttcccggatccaggtccttacagtacccatccaaaccatttatgaggacgaaaacaggagaacccattttaaggctgttagagacagcttaaaaatcatccgtacccttggtgctgattttatgaaattcctttcatcctcctttgtctgctcctttgttgacataggcctggcctgggtgcttctggaccttctgaggccttatgtgcaggggaaggacttcttaaggatcatgattgccacggcagccgccagaacggtttccattgctgtaaattatctgttgaataaaacggtggtgtttaaggacaggcacggcccgggaaacagccttatccgctatctggctctttgtgtctgcaatatactgctgtctgcaggcggtgtatatcttcttcaccaagccctgggcgtccatgaaaggctggcaaagctcctttgtgatgggtgtctgtttcttattggttatcaaatacagcaacgctgggtattttcccgggaagagggctggttccatgaataaagaagagaaaaaacgaaatgtaattttcatcatagcaatggtcctgatgaccatttatctgggttggcgtctgatattcaccctgccgtttcatgagggtgcaatgagtctggtgtttgggctgctattggccggtgcggaaactgttacggtatttaccacctttgagcttttctatcaaaagatgcagatgaataaattccatctggaatgcccggaaataccggatgaagattatcctcatgtggacgttttcattgcgacccataacgaaccctctgatgtcctgtacaaaacggtcaatgcctgtacgtttatggcctatccggataaaagcaaggtacatatttatatttgtgatgacggaaaccgggaggagatcgcagggcttgccaaagagtttggggtcgggtatctggggcttgcagacaataaggatgcaaaatcaggcaattataataacgctttaaggaaaacttcctctcccctgattgccacctttgatgcggatatgattccccagcatacgtttctcatgaagacggttccttatttcctcctttccagattcataaaggaaaatgggaagtggaggctgagaacggaagaggaaatcgaaaaaaaattcaggcttggattagttcagacgcctcagagcttttataatcccgatctctttcagttcaacctgtatgcggagggaaacattccaaatgaacaggatttcttttccagggaagtcaatgccatgagaaatgcttccaatgcggtcgcctatacaggcagcaacaccgttattttaagggaagccatggaggaaataggcggttttccgttaaacaccattacagaggattttgagacaagcatacggatacagaaagccggatacatcacctatgcaacggatgagatacaggcggccggacttaccacaacaacggtaaaaagcatgatcaggcagagggtgcgctgggcaagaggtatcattcagagcctccagaacacccgtgccattttttcttccaagctttccccgctggcaaggcttacctatctgaacacttttttatactggtggtctttttttagcaggctgatattcattatgtctcccattctgttcgctctgtttgattataagatcgtaaacagccatttttgggatgtaatcgtgctttgggtacccgcatactttttttacagcatatccatgcgttatttgtcgagcaatatcagaaaccacagatggagtcagatcattgacaccatattcatgccctatttgattctcccggtcctccttgagacccttcacatccatcaaagggaatttaaggtcactgataaaaggagagaagggaacggctttggctttgccatgtttgccattcctcatgtggttttactggccctgtccgcagcggccatggtgcgctttgtgcatggaaagtacggctgggcattattctacagcagcattatcctcttctggatcacttataatatgatctccttattctatgccatattttttatgctgggaagacgggcttacagaagcagcgagaggatccgggcagaggaacttatcaccatacagtataagaatttaggctatgaagcgaagactgtggatgtttcggaaaacggcctggccttctggtcggaaaagcccatttatcttccggaaaatgaaactgtaaaatttcaggtcaccacacctttctataaagccgggcttgagggaaagattgtttatgtgaaagagcaaagcggcggctggcggtattccgcagctgttcagcctgttgatgatgaaaacaaacgccagtacatgcaggtgatatacgacaggacccattctctcccgatgcagatggatttatgggtcactgcctatgatgatatgctgagaaacatgaaaagacggctgaggcggccgttttcagacaaaagaaagatgcccaggatccggctggagaaagaagttatttttgcaaacggagccacctgcaggctggtggattttaattaccattatttttcggtttccggttttaatgataacgggagccaggaggatcagttcatctacaggacagaaagcgggatccctctggtcttaaaacggacaggtatatacatacggcgttcatcagaggagcttttgtctcttgtgaatttaaatgaacttataggggaagtccagatcgatcaggttttggctgacataacaaatacaggcgaaaaagaggggtaagggatgagcgttatagtccatagtgtcatggcaatggtgcttttgtgttctttatgcggctatatgatgtttacaagggcaaggctgaggcttcaggcggaatttgttcctgtttttgtctgctcggccattgcctgtgccgtttatctttgcggactggccggatttttgctgcaagggtcatcggttgtattagcggcagggattcttttgtttctcttctatttatcaaggcttgtcagggaaaagtcctatagaaatttccgcttttccctgtttcaggcaggatttgcccttgggagcctgttctttttccagcttttactggccagcaggctgatccattacgacaatttttcccactgggccatagtggtcaagcagatgctaagtaccaatgcatttccggatgcggcatctgctctgatcgattttaaaaattatccgctgggttcttcctcatttctgtactttgtctgccgttttgcaggaaattcccaggctggcagctcaggggatcctgatcttttcctgcttttatgccttgtttggggtgattggagaaaagaagaggtttttgctgttcgcttttctggctgcaggctgttccctgttgtccgtatttaacattaccatacggatcaccaacctgctggtagattttcttcttcctgtttatgcccttgtgttatttgtgatgatatacagatataagaagaaaatagaaaaggcctgtatcagtatgattcctgcagcaggacttttaatgatcataaaaaatacgggaatcatatttgcgggaatcgggtttttgtatctgatctatgcctggctaaaaaacagggacaagcttttttggaaaagcgggctggaagtgtttctttcagccggagcggcctttcttccatatttgttatggaacatacatatggcggagggatttaaggggacagagaacaagtttgaagtttccgcccataacatccgaaacgtttccggcgggaaaagcccggaagagatccggcagatcatgggactgttcgtcaaatccgtgtttgacatcaccagccgccctgctatggggattctgggttttaatattgctgcaataattgccagtgtgtttgttgccgtcatattaaaaaagagctggaatctgtggaaggcactgatcgcattaaacctggttttgatgggctattatcttggcatacttgccctttatattttttccatgcctcttgacgaggctcttcggctggctgggtttgagcgttatgcatcaagtattgtgattttgtttgcaggagggctggtgctgtgcgcggccgttgatattgaaaaatccttttactacagatacggagagcttccggactaccgggcttttaagaccgtagagagcaaggggcggtatcagaagggcattatcttttttacggccatggcaatcgccctgctgatgtcggaatacaatggcatgcagaccatcaggagttcctacaatgccactctgccttacaaggtatcccgcgttacgggggatcgctggtattcaagcggaaaggtggatgaaagcaggtatttgttttatgcatcagatgcggatggccaggtgacggattattacctgcaatacatagggaaatatatgctttatgcctccaatgtagatgggatttgtgcgttttatgaggataacctgatccatttgttaagcaactataattatctggttgttgttgaaagcgatggggacgcaaaatatctgctgaaaaagtatttcggcgtctccggaaaagagggagtctatcggatcgttcactcccggaaggggctggaagtgaaactgacggggtgaaaggctgtatacaaaaatagccgcttcataaaagaatggtgatgatcatttctttatgaagcggctgtgttttatttaaaatttaaactgttccataagtccctttaatatctgagcctgaccggaaagttcttcgcttgtggccgcgctctcttctgctgtggcggagttagtctgaaccacactggatatctggtcgatccccagggctacctgggcaatggaactggcctgttcctgggacgctgcggcaattccatatatcagagaagccattttttcagaggaggaggcgatctgttccagagaatttgctgtttcccctgcgatatccgtacccttctgcacagaataggcagagctttcgatgagggaggcggtattccttgaagcctctgcactctttgatgcaagattgcgcacttcatcggcaacgacggcaaacccttttccggcttccccggcacgggcggcttcaacagcggcatttaaagccaggatattggtctggaatgcgatatcctcaattgtctttatgatctttccgatttccccggaggtctgattgatctcgttcatggcatcggtcatcctcttcatctgctctttcccgttttccagatgggaggaggcttctttagcctggagagtggcctcttctgcgtttttggcatttagatctacatgagaggatatgaggcttatggtggcgcccagctcttccacggaactggcctgttccgtagctccctgggagagggcctgtgcacctgcggaaacttgttccgcaccggaggctacttcctccgcagaatggctgatctgtaaaagtgtctcactaagcctagaccgcagctgggtcatggcctgaaggattccgccgaaacctcctgcataggcggattcacagttggaagaaaccgttaatctgccatctgccatctcgttgagaatatgatccacatctccgatgatcattttcaatccgtccaccagctctctggtggcgcctgccagcacgccggtttcgtccttggtattgattacaggaacaggagaatctaagtcgccctgtaccagtttctttaggcgttcagcacaggcagttatgggatttccgatttttcctgccagaacaacggatatgattccggctacaatcagtgccgcaataagcagtaccgctgaaatgacgattccggtcatggtggcgcccataaagtctgtcatgggcgctttaagaccaaagctccagccgtcagtcccttcaatgggcgcataggccaggaattcctttacacttcccctgttgtaacgtccaaatccgctttttccttctgtcattcccttttcaagagctgccagggcggccagcccgggatctgtctttgcaatgtcctgggtatttgtcccattgattacattctccatatccacatcagcgatgaccccgccgtttttgttcagtatgtaagagttgcttcccttgcttatctttatgctggcaacgatatcatttaaaaaggtttcagtggggacaaaatatacaacacctactactttggtatccggaacgcccttatcccacaatggggcggatatgataatggtaagctctcctgtgaccttgctgatcaagggatcggaaaccgctgtctcaccctttatggacctttggaaataatcccggtcagaatagtcctttccatcgaatatgctgaccccgtctgttcccagtatgtttccccgctgaaaaccgtgagactttgctttctggtccatgaggatctttttatcttccacactggtttcactgctggaaagacggttggtgctgccgacttcataggcaatgtttttataaatatccagctctttggaaacccgctgggaagcggtgagggcaagttccgtcatggtctggttcatggtcccgatcatgctggaatagtttaaataaatgctggtacctcccactgcgcataaagaaataaatactgtcaaagccatgctgagcaatatttttgttttaatactcttcataatcatttctcctttgtactttgcttaagcctgaaataacaggaacggaaagcagagcttctatatcattaagtatactttatgatggtaaaaatgtctaatttctttttctgtattctatagaatatcatggagaaatcattatgaaaggtgtggagcatcttttatacgcagtgcctggaaggaacctgtattccggtcctgcaccacatgccggggaacctccgttcatatgatattaatatcgtttatccggattcatcggaaagcttttcctatggatttttggtgcaggaaaaaaggctgcatttacttaccgctattagagggctgcctgtgcggaaatattcgataaaacgctgacgaaataaaacaaaatatatgggaaacagtaaataatggttattaagggctatgcccggaagagttttatatattcttccgggcttattgttgtatggtaataaggaaagttccggaacggtttccatgcatgtaacaggctctgtttcccttaggggtcacctccgttcaaatgattgtgccaataatttaggagtaatctatcaaatgttgcagaaaagttgacgcgcacaaaaaatacgtgctgctataatgtgtataacagacaatgaaatacagaaaagagaggggtattaagcgatatgaccggtcggcaaatgaatattctaaactacctgcgggaacagaaagattttgtaactgtttcagaaatctcccgtgtgattcaagtgtctgtaacaaccataagaaatgaattaaacgtgattcaggataccattgaccaagcgaacctgggaaagatctgcaaaaaaccccataaaggcattaagctcgagatggccgaggaagcatggaaccaattattgttcctatcggaggaatcacagctgaacagtgatattcctgaagcaaaatatcaaattatttattatttactgacagattgtaatttgagcctgtcttatattcagaaaaagttttatataagccgttccttcgtggaaaagctgcttcctgatttaaaaaaatggtttcagatatatggaatcaattttgataagaaaagaggaaaagggtttcaaatcaaatatgaagaattccaatggcgccttgctatgtggaatctcttcttaagtgtgaagcaggaaaacagtaaggactatctgcccggaaaacagatggaataccaggcaattgaatattctttcatggaaagcttcctaaaggggtttgatacttccggagtcaacagggccatatatcatctggaggaagcttatggtttttcttatgggtatgaagcacatattcagatgtttttcctgctgtccctttgtattattcgttccaggcaaaaacatatgatacggcttccggcagcccctcccgttaaaatatcaggtgaattttccggaatgataaaagaagagcttatcaaaatgctggaaacctgttatcagatgaaattggactcaaatgaaaaggattatgtagggtttgttgtagagatctcagatatacaaaagtttcacagtatgaatggaatgtgtgtgtgccaggcggagaatctggaattgtgttattttacgtttcgtatggtgtccttaatgagcgatattgtaaacgtaaatctgaggtcagatacattttttctggaaagcctgtttctgcagctccattcaatgataccaagattaagatacaatataagaactgaaaatccgctccttaagcaggtaaaacagcggtatcccaatattttcacagcaatatccgctgtcagcgtttattttcaaaaggagcttggactggatatcaatgaacatgagatgtgcacattagcgctgctgcttggaggcgcaatcgaaagaagcttatcaacagttgctgcctgcgttgtgtgtgattacggtttaggcatatcccagttgctgaaagaacaattggaacgtaccattagtgacataaaaattgtggatgttctttccgtcagggatcttaaaaagatcatccatataccttgtgacttaatcatcaccaccattcagttaaaaaacatctgctatggaaaaacggtggttgccgtagagcatcttttaacagctaatgatattaaaaatattgaggatgccatgaaactggttcgcaggaggaacataaaaaacaggcagcattgcagtaagttaagtatctgtaaaaacctgttttatgaggaatttatgtttctccacatggatgtcatggataaacaaagccttatgagtcttttatgtaaaaagctgactgaagcgggatatgtgacggatcagtttcttccgtcggtcatggagcatgaagtaacggctcccaccgcacttggaaaagggatcgcattgccccacggatttgcaaagtatgtcatgcggcctacagtagccattgcaacacttgcagctcctattttgtggcagggtaaggaaaaggttgatgtcattttccttttggcctttaaccttgatgaagcagttggtatgaaggaagaaaccataaagttctacagtgtttttttggaccttctcgacgaaacggagaatatcaacaaaatcagacaggccggtgatccggaggcgttggcagaattgatgaatcaaaaaatcatgaatgcagttgtattagaggaataaaaacagaggaggagcctaagtatggcggcacatgtaacacatatgacaatagaggatgtgattcagcgctcatgtattaacctgcacttaaccggcaggacaaaagaggaaatcataatggaaatgacggatatgttttttaattccggagccctttcttcgaaagaacttttcttaagggatgtgtatcagagggaaatggaggggccaaccggaatcggcaatcaggtagccattccccatgggaaatcagatgcggttattcgtacttccatggcagttggcagggcagatcatgagattgaatgggaaacactgggcgatggaaacagcagggtatttgttatgtttgctgttaacagcgcagacaaatcggaactggtttcactattatcacaggtggcagttgcattatgtgatgataaggttatagaaacattattgttgacagaagatgcggaagaaatcttcacactattcaatcacaaggagggaagcaagtgaaaattgtcggtgtagcagcctgtacggcggggatcgcccatacctatatggcgcgggaaaaactgatgaaaggggcaaaagcgagggggcatgaagccaaaattgaaactcagggtaccataggtacagaacataagcttacagatcaggatatattggaagctgatgtggtaattctggcagtggatgtaaagatctcaggggaggatcggtttaaggggaaaccggtcatccgcgtaggaacagccgttgtaattaaaaatgcaattggattcatagaaaaggtggagaaggcaatctcaaacaaaaagtaaaggaggagataaaaaatgaaagagcatggagtgatagcattcattaaaaaacatgtattgacggcaattggttacatgattcctttagtagtagcggccggattgtgcatggcactgggacagtttattgacggggatgtccgtaattccacatctggtatcggttacttcttatataaggcaggcggatttggtatgtcagccgtagtgcctgtaatcactgccggtgtggcctattccatggcagacaaaccaggaatcgcgcctggacttatattgggctttatttgcacggagatcaaagccggttttatcggaggcattgtagccggttttttagtcgggtatctggttctgactattaagaaatacataaaacttcctcagaatatgcaggggttaatgcctgtcatggtaatacccgtactgaccactgccgttgccggaatattaatgttcacagttgtgggtcagccgtttgcctggcttcaggtaacgctcacttctgcaatctcaagtcttcaaagcggttcaaagtttgtatttggagctgtactgggagggatggcctgctttgacttcggagggcctgtaaacaagaccatgtctacatttgtcaatggactgatgatagacggtgtcattgagccggaagccgtgaagtttgttggctccatgattcctccttttggcatcgccatctcctgcctgcttaccaggaataaatataccagggctgaaaaagaagctttgaaggccgctgttcctatgggcttttgtatgattacagaaggtgttatcccaatcgctgcaagagatctggtcagggtagtttttgcatgtgtctgcggttctgcggtagcaggtggtttatccatgacctggggctgtggttctccggtaccgcatgggggcatgctctcggtacctctgttcaccaatccggtgaaattctgtctggcgctggctatcggcagtgtgattacaggagtgatattatccgcaatcaagaaaaaggtgacagaagaggatgaagattttgaagatctgggaactgtcaccgctgatatggaagatattaaaatagaaatgatttgacaaggggagaagaaaatgctgattaatatgaatgaaatgctgaaaatcgcagaaaaataccaatttgcagttggagcttttaatgccacggaaagttctctgttccgggctgtcgtcgaggaagcagaggacagcaattctcctgcgattattcaggtggcaccgggggagtttgattttgccactagggaattctatacatatgtaagggaacggctggcagaaagcagagtaccgtttgtgctccatctggatcacggtaaatccctggagcactgtatgaaggcggttcaggccggttttacttctgtcatgatcgatggttccgaactttcgtatgaagaaaacatccggatttcaaaggaagtatcagaacttgcacatatgataaatgtatcagtagaaggagaaatagggaccattggggtcatggataattccgatgaggggggagtcagaaatgtgacttatacaaatccggaagatgttacggaatttgtttcccaaaccaatgtagactgccttgccattgcaattggcacggcacatggaatatatcccaaggaatttaaaccacagctgcggcttcagctgttgagagagataaagaatgtatctcctgttcctctggttcttcacggtggaagcaataatcctgatgaagaaatacgtgaagcgtgtaaaatcggaatacggaaagtaaatatatccagtgattttaaatatgccttttttaaaaaagtaaatgaagtaattgaagagaccggaggctttatacctgctaaagtatttacacctggaattcttgaggcgcgtaaggtgattcggcaaaaaatggaattatttggttccctgggaaaagcggaatgctacaggtagaggagtatatgtatgataaattttaggttttccaatacaaccgaaattgtatttggaagaaatacgcagaatttgataggggagaatatcagaaaatacagcgattgtaaaaaggtcctgatcgtatatggctctgaccggataaaaaagaacgggcttttcaacaccgttgtcaaagcgctgaaaaaagagggtttctgttactgcgaattgggaggagtccggccaaatcccaggctcggtcttgtgaaacagggaatcgaactgtgcagaagtgaaacagtgggctttatccttgcaatcggaggcggcagctgcattgatactgcaaaagccattggcgtaggagtaccctatgaaggagatgtatgggatttttatcttgggaaagaagttccccaaaaaacgctgccaactgcggcaatattgacaatccctgcggcaggaagtgaagcaagcctgagctcagtcattacaaatgaggatggctggtacaaaaaaagcattaatctggacttgatccgcccagtcttttctattattaatccggaattaacttttagtttacctccctatcagatcagctgcggagttgtggatatgatgactcatatcatggaacggtatttcactaatactgctgaagtggatttaacagacagattatgtgaggctgccttgaaaagcattattgtaaatggactggcaacgctaaaggagcctgatcattatgatacaagggctgaaattgtatgggcgggaacattagctcacaatgggctgttaaataccgggcgggaacaggactgggcttctcacagaattgcattggaaatgagcggaaaatacgatattgctcatggggcaagtctgtccattgtttatcctgcctggatggaatatgtatacagccacgataaaaacaggttcgtccaatttgcagtaaaggtatgggatgtagacatgtcctatggaaaaacggatgaaatctgcctggaaggtattcggaggatgcgtgaatactttaaaaagctgggtatgcctcttactttttctgatgcaggacttcctgccgatgcttttgaggaaatggcagataaagccaccttcaaggatacaattcctgtagggaatttcgttaaaatagggaaaaagcaaatgattgatatctatgagctttgtacaaaggaaatcaaactatagtacatagaatataattagaatctgatcggtacgttgcttggagagggtcctgatgaaccgccttaatgaagcagaacagatacttccaaaataacaaaaaaatgaattttaatatctaagaaatgggagagccttgtttgaatacaggctgctcccatttttgtgttgaaaggagtgagttttataaagagactggtactgaaagaactataacagatttattgaaatgccttggccggaaaaatggagataattcattttcagatggtcacagagagaatcgaaggcagcgggaaactgacgggttcctggggcctgatgtggtcagaatgtataaggcttatttaagaagcagaatatttaaaaaagtgaagagatttcttttggcaaaaaaaggacttgttattaaaattattattactaaaaatgtattgactaaaattattttatataatataatgaagatacctaaataatataaaaagtttcaatgttaattgtgcaatatgcacgtaaaaaagggggtattatttatgtttaaacaactgcaaaaattgggtaaggcatttatgctgcctattgccattctcccggcagcaggtcttcttctgggaattggtggagcactgtctaatccaaacactgtggcagcctatccattcctgaacatttttgctctccaggccatattcacggttatgagcaaagcgggcgaggtagtgttcggaaatctgtcactgatcatgtgtattggtctggctgtgggccttgcaaagaaagacaagggtacggcaggactggcggctgcggttgcgtttctggttatgaacgcatccatcggcgcattgctttccgtctttaatcctgaaggcagcgccattgacaccggagttgtgggatctattgtaattggctgtatggtcacttatttccataacaggtaccggaatatccagcttccggcttttctgggatttttcggcggctcccgttttattccgatcatatcttcctttgcggcaattttcgttggtaccgtattcttcctgatctggccaacctttcagagattgctgatttccagcgggcaggccattgcaggaatgggagtgtttgggacctttttgtatggatttttaatgaggctttgcggagcggtgggacttcatcatatgatctatcccatgttctggtatacggaattaggcggagttgccactgtggcaggccagcagattgcaggcgctcagaagattttctttgcacagctggctgatcctaattttacaggaatgtataccgagggcacacggttttttgctggccgttttgataccatgatttttggattgcctgcagcctgccttgccatgtatcactgtgttccggcaaagcgccgcaaaatggtatttggtttgttcttctcagcggccctcacatcgtttttaacaggaattaccgaacccattgaatttatgttcctgtttgtagcgccgtggctgtatgtggttcatgcacttttggatggcctttccttcgcaattgcggacctcttaagcgtgcgcatcggaaatactttttccggcgggatcatcgacttcaccttgtttggaatattacagggcaatgcaaaaacccactggatctatgtggtggtggtaggcattttctgggcggctctttactatgtgctgttccgttttctgatcacaaagtttaatatacccactccaggccgggaagaaggcgaggatgacgagatcaatgtggaaacaaagggcactatagccgaaaccgcggttcgtgtgcttgctgctttgggcggtaaggaaaatattgaggattgtgatgcctgcatcactcgtctgcgtgtggctgtaaaggatataagcaaggttgacaaagacgcaatcaagcgggaaggagcgacggccgtactggaggtgaagggaggaattcaggcgatattcggagcgaaagcagatttaataaaatcaaaaataaatgagataatcggtgaggactaaggagatgtgttgcttatgaatagaggtttaattgtatcctgtcaggcgcttccacaggagcccctgcacagttcatttatcatgggacgtatggcagtggcggcaaaggaaggcggcgcaatcggtatccgtgctaacagcgttgaagatatcgaagaaatcaaaaaaaatgtggatcttccgatcattggaataatcaaaaaagtatacgcagagggcaaaccttatataacgcccacattgacagaggtggacgctttggtccgtaccggcgtggatgtgattgcggtggatgctaccataaaccaggatgtggattttctccataagcttcacgaaaggtaccccaaccagaaatttatggctgatatttcaacggaagaggagggcctgcgtgcagatgaaataggatttgattttgtgggcctgaccctgctgggatatacgcctcagtctttgggactggataaatttcaggtgcttcagtccctgattgcaaagtgtaagcatccggtcattgcagaaggaaatttcaacacgccggagcaggcagcaaaggctattgagctaggcgcttacgccgttgtggtgggaactgcgatcacacgcccccagtgcatcactcaaagatttgccgaggcggtgtcaaaggtttctaaataaatttatgcagcccttcctgcagctttctataggaaagcgggggaagggcttttttttgtctttttgatggaacctttttgtttttttattgtgactatgatataatatgaacatttagtgagatatttatcgggtttcgtgtcatggagaaaacaacaaaagtacaaggggtaccaatatggacattctaacatcaattcaaaaagaatatcagacttttacagataaagaacgaagaattgcagattatatcctacaggaaggcaacaatatccggaacatgaatatctctgtgctggccgctaccgtgggagtttctgacggtaccattacccggttctgcaagaaggtagggagcaaatcctttgcagagctgaaaatccagcttgggagcgcaggggcaggcaacaaaattgcccactccgacgatctcgtgacccaggtgtatgatttttacaaaacagtaattgaacattctaacaagatgatggatatgaaggcactgggagacctggcagaccagatcgttaaagcgggaaatatctatgtctttggagtcgggtcatcagggctgactgctgatgaaaccatgctccgcttatcacggatgggatttcatgtgcaaagcgtgacggattcccatttgatgctgatttacagctctattttgggggccggggatctgatcatagccatctccatatccggtgaaaccgctgaagtcgccaatgcggtcagagtggcgaagcagaatggggcaacggccatctgtcttaccagcttcactaacagcaccattgcacaatgtgcggatttttgctttcccgtagtcaatcctctgtttgttgaccaggaacggtttgtgaacagccaattatcagctctttatatgattgatctactttgtctggttctgttaaccgatgaaaacaggaagaaaaagatgaatattacggtagaaaccattgttaagcagtctcatttgaagtagattgttttagatgattcctttatcagggtagtgtagattaaaaaatgattgggtaaaaggcggagcgggcaagtgccttcccagctggcgtatcccactgaaagaaaggatttcatgaaatttgatgtttataaactggcagacaaatacaaactgacagacacggaaacccagatattaaattatatcctggaaaataatcaacaggtacttcatatggcggtacgtgaagtggcaaacttaaactttgtgtctgccgcaaccataattaaattatcaaaaaagatgggatataccggatatacggatatgatataccgtcttaatttcatgatgacaagccatcggaaaaataaagaaaggctgtcggacatcaccagctttatcaacgatataccggatgaaattttaagtgatttcatgaaccagttaaagagccatagaaatgatattattttagtatcagccaccggcttttcttctaccctggcggaatatatagagcgcaagcttctggtaaccggtttccgggtcattaagaccaacgcctatgcggtctatgataagaaccggcttggggcatccctggttcttgtggtttcaaagagcggtgaaacggataccattgcaaagcttgttgattatgcgaatgaaaatcaggtggacgtcatttcctttaccggggaacagagcaatcacattgggcgaaagtctgcggtaaatattcccattctggatgacaagacgctggatgaccggaatcttcagtccaactatttttatgcacgggtgattgtggtatttgaatatttaatgagtcaggtaatggaagaactggattagtccggttcttctttttattttcccgtattggaacatattagtaacaaaagtaaatatgttcactatatggtcaacatgttgtgaataacggggaatatattttggtttgtgtgcaagtgtgataaaattccatagcaaggtaattaccagtgaaaacaaaaatgtatggaggaatacgaaatgaaggataaagcagtaaaagcgatgcaaagcttttccaaggctatgatcgggccggtgttatttttacctgtggtaggtatgatgattgccctgaccgcgatcatgaccaataccgcatttgtttctgaaggaggaccggtgtggaccatcggcaaattttttaacagcatgctgaattccattatggggaatttaagcattctgttctgtgtgggaattgcaaacggcatggcaaagaagaaaaaggcagatgcatcattcgtggcattgctggcatatatcatgtttttaggtgccaacagcaagtggctggagctttccgggaagatggtggaaggggcaactgccggggccttatatggcacgggacagaccattcagttaggattccatgtgacggatatgggcgtgtttcttggcatgatcatcggcgttttggtggctctggttcacaacaaacactgtgataccgagtttaagggcggattcgctccttacggcaacagcaagcttgtttacatgatcatgattcccattattgcagtattgagcattggcgtgacttatgtgtggccgggagttgcaagcggaatctccgcattaaccggttttatgagcacggccggggcagcaggcgtatttgtatacggattcttaaaccggttcctgatcccgacgggattgcatcacttgatctggtctcccttcctttattcggcggtgggcggacaggcggtgatcggcggggaaaacgttatcggtgcaaagcccatcttcctggcattgctgagtgatccggcagcaggaatgatgccggatacctgtcgtttcctgacttatggtctggtgaagacctttggtatcatcggcgtggcacttgctttctatgtaaccgccaagaaggtgaaaaaggcaaacttaaaagcccagatgatcccggccaccttaaccgcagtgatcgccggcattacagaaccgctggaatttacttttatttttgcagcacctttgttatggcttgtatattctgttctggatggctttttccagatggtggtttatttgatcggtgtccgcgtctgtgccaccaatgggatcctggacttcctggtgctgaatcttccggcaggagccggcagaaccttatggcccttatacgtactggtgggtctggtggagattcttgtgatctttgtggtgtttaagtttatgatcgaaaagctgaacttaaagacacctggacgagaggatgatgatacggaagcggctttggatttaaatgccaatgcagcaagcgttaaaaaggaattaaaggcaaaacagtccggaagcggagagactgaggaagaaagactgacccagggcaggaccatcatagaagcattaggcggaaaagataatatcttaagtctggaaaactgtttttccaggttaagagtggaagttgcagacagttcaaagatcgatgaagcggctttaaaagggaccggagcggccggcattatgaagaaaggaaatgctgttcaggtggtatacggtctcagcgtttccaaaatgagaaccttggtggatgatgcgttagaaaagatggaatcaaacaaataaggaggaaaagacatgaacaagacgtttaaattagtcattgtaggcggaggcagcacttatacaccgggaattgttaaaagcctgctggatcagaaggatcaatttaagctttctgaattaagactttatgatactttcaaagaacgccaggacaaagttggagttttggtaaaaaaggtcattgaactgtttgatcctgaggtgaagctggttcttaccacagatccgaaggaagcgtttgaggatgcagattttatttttgcccagatgcgggtgggattatatcacatgagagagcttgatgagaaaatccctttaaaatatgatgtggtaggccaggaaacctgcggaccaggcggccttgcatatggcttaagaaccatttatccaatggtggaagtcattgattactgtgaaaaatatgcaagcagggattactggatcgtaaactattccaacccggccgccattgttgcaaaggcaatgtataagctccgtccaaatgccagaatcttaaatatttgcgatatgcccgtggcaatcatgagaaacatggcaaacattttagattgtgacagaaaagacattgtgccggattactttggattgaatcattttggctggtttacaaagatccgtgtaggggatgaggaccgtacggaagaattaaaggcttatgtaagagagcatggctatatgcctcctgatgaaagaagcgaagtgcgtcataatgacgcttcctggaagcatacctttgacaatgcaaagaatttaatgagaatgtttccggattatctgcccaatacctatctgcagtattatctgttaggggatgagatcgtaaagcattcggacaagaattatacgagagccaatgaagtcatggacggcagggaaaaacggatcttccaggcagtggaacagtatgaaaccacaggggaaattgacatgactccattctttaccggcgttcacggagaattcatcgtggaagtggccatgagcctggcgtttaatttaaagaaacgccatctggttatggtcatgaacaatggcgctgtcaagaacttgccggacgatgccatggtggaaattccctgctacattaccaaggaaggaccggaagctaccagagtaggggaaattcccaccttctttaaagggatggtcgagcagcaggaggcttgtgaaaagctgatcgtagaagcagcaatagaaggaagctatgacaaggctttggcggcatttacattgaataagaccataccgtcagccatggtggcaaaacagattttggatgaaatgattgaagccaataaggaatattggccggaattaaaataaaccaatcaattacaggaacagtgtcagatggatctgattccggtgtttgaaaataggggagtttttaacacgccggggaaatactgcatattcagtatttccccggcgctttgtattgtttccggttattttatctcgcatatttttcaaaaagacagaacattgtgatacaatattgacactaaagcaaaaaaagaatacaatctatataattgtgaatttgattcgtatatataaactttcggaggtatgagatgaatcggaccgtggaacgcacatttatgattttgcagttgatagcgagcagaaaaagagggatcaccttacaggagattacaaatgaaatgggaatggctaagagcagtgtttttgtcatcgttcagtcattgctggagttgaattatattacaacccttcgtgataatgataaaaagtattgtttgggaatagagaccttttctttgggtatgaagtatgtggatgatatgagccttataaaagagtgcaccgtaaatttacagccaatagctgaaaaatataataaaacggcttttgtggcagttttaaacggaaccaagatcgtatacgttcataaatacgtggctcagaatgccagactggcttcatgcgccattggaaccagaaaggatgcctatgccacttcccttggaaaggcgattcttgcatttttgccgaaagaggaacaaagcgcaattatcgataagattgattttaagccattgacagactacaccatcacttccaaagagcagctgctggaagagcttaggaaaacaaaagagcggggatattccttggatcagagagaactggaggatattaccagctgctgcggagcccctatttttgactattcaggaagagtggcagcggctgtttccttatcggatatctacaacgaatccattgatgacgagcaggttgcccaggagttaaaagaagtggctatgaacatatcaaaaaatttaggatatcatcccaatccgtgatgtcttcttttttatttcacaaacaatgtcagctatgcgagaaaaccgccttttgcttttcatgatgaaatgcaatgcaaaaggcattctcgcatttattatttgtcctgttttgagaagaaatattgctaatatgtagcagaacaatataaagtgcacatttatattgacaaaaatagaaatgaaatgtataatatgctcatgttaaaaacttagttcttatatatgaactttttcggttttaagatctcttttatagagatctcatttattaaacaatatcgtgaacggagttcttaattatgaacaatacaaaaggaattgtttctttccgttatctggacttattgtttttttccatacttgcggctgtttcagagattatgagctatgagactctgaaattttggagcagcagcttttatttcagcttttccatggccctctgtctcatatccatgatccgctggggagcggccggagtggcagtagccatgatcggaggcatacccggcatcctgttttctgatatgccgttttggtccggatttttattttatgtcttgtcaaatgcatttataggaattcccatgctggtttatggacacagaaacagggataccattgccaacgggcatgtttttctgctgctttatatctttctttctcactgcagcctgtctgcgggaaagggaatgattatatttttactgaccggagaattaacaggagccatggattattttggggcgacattttttcctttgatgatcaatatcattgtgtgctgtgtgctgcaaatgcggaaagggcttatctgtgatatgagatattattttactgagatggaaggagaagggaatggaaacggaagaagttaagatgcgaaaaccgcagacaaaaaagatatggaaggcggtgagaaaggattggcgtttgtatgtgctcctgcttccgctggtgatctggtttgttttgtgggcctataagccaatgggagggcttctcattgcatttaagcggtttgaccctcagtttggagtctggggaagtgaatttaaggggatcgacaattttatcaacctggttgcaggtgtcaatcaggttgagttctggcaggcattcagaaatacttttatcatcagtgcctacagccttatattcggattccccgtccccattatcatggctttgttatttgctgaaatcggaaatgatacggtcagaaaattgacgcagacagccacctatctgcctcattttctctcagaagttacgattacaggcattgcccttatgctggtatacagcggtgtccgctcaagcggaatcattgcctctttgttccagcacataggactgattgagccgggaatgtccatcatgcagaaatccaattatttcaggcctctctatattatggtggggatctggaaggaaagcggatacaattccatcgtttattttgcagcgattatgggaatttccccttctctgtacgaggcgttaaaagtagacggcggcaataaatttcaggaaatccgctttatcacatttccgggaatggctccgactctgatcatcatgatcattatgaggatcggaagcatgctgaccattggttatgaaagggttttgcttttatacaatgcgaacatttatgtgacagcagatgtgctttccacctttgaacaaagaatcggtattttgtcaggcaattatggaattggagccgcagtaagcctgttcaattcactgatcgcgtttgcactggtgatcggtgccaatacgatcagcagaaatatatcggaaacatccctgtggtagattaggaaaggcggaaacgatggagcgcttaaacagaagtgaaaagatatttaaggtattttcctatacgatgatcatcatctttgcattgcttgccctgtatccggttttgtacgcgttcagcgtgtcgatcagcggaaaggtggcgtatgaaagcggccagattgtactcctgccaaaggaagtgacatttcaggcttacgacatggtgctgcacaataaaggcttttggatcgcatacaccaataccctgttctacaccgtacttggtactgcctggagcatggccatttccattacaggtgcttatgcgctgcagaaaacaaagctgatgttcagaaggcagtggaactttttgctggtatttaccatgtggttcagtgctggaatgattcccctgtatttaaattataagaccatgcacgtggataaccggtggggaatgattatagcctttggtgttcaggcatataacatcattcttctcagaaattatttcagcagcattcccaaggagatagaagaagctgcaatcatggatggggccaatgagttccagatgcttggaaaagtttacatacccatgtcaacagccagcattgcaacagtaaccttgttttatgccatttcaagatggaatggttattactggtcaaggatgctgctggcaaacccctatgagcagccgctgcaggtatacttacggcagctgattgaaaactatcaaaaattatacgatgaatcaccggtcaatcttgcatattccgcagacagcctggcttatgccatcattatatgctcgatcatcccagtgttagttatttacccttatattcaaaagtactttgcaaaaggcgtgaatatgggggagtaaaaggataaatgatttattcgccataaggcagaaggaggatttttatgagaaacaaagtagcagggggtattctgtgtgccgttatgcttgcatcggcattgaccggatgcggttcttccgttgtggatcaggcatcgacccgggcagcagaagaaacacagccggaaaccagcgaggaagcaggcgatcagactgatttaacagatatggttgaattaaagtttaatattgccaatggaaataagtccaggaccatgacttacaaccaggagtctccattgactctgccggatggcaccgttgtcacagccggtatgttaaaaccaatgtggtcttatatggaaaaggaattaaacagcaagttttcagatgtgacggtacaggatgtgaaggcaactgatatgatccagacagaatccacatcaaatttctccggggccaatatctatggaggcgaatccattgcagaacgccttatgttttatggaaccgaaggaaaattcgtgaacttaagcgaaatgatgaaaaccggctatatgcctaattttaaagaatatttatctaaaaatcctgacgtaaagtctgcgatcaccgcttacgacggaaatatttatcacgtgccttatattgcggaactgaatcagatagcaaggacctttgttatccgtgaatcctgggtcaccgggcttttggatgcagaaggcgccgcctatgataagaattcctttgatgtgcattataaaggcttttatgtggaaaacaaccgcagaacaggagaaaatggtggaacagttactccaaaagaaggaatcgacattgtaaagaaaacggaccaggatattattgaaattcagaatgccctggaagtaaaaaatggcgaaaccttgaccaatgcgctgatccagtacattaaggataattacgattatgaaaacccgtcggaattatttctgggggaaaaggctgcctatgacattgatgagatgatcgccctgatgcgctgcattaaggcaaatcccactctgctgaccaatggaaaagcaaacgtggtatggcctctttttgtcaggcagtccaactaccgggaggatttgctccggttatctacatattttgacggtgtgaaggtccatggtgcagactcctacggcgcaagatggtacattgatgagaacggacatatccagtatacctactcaaaagaaggcgtgtacaatgtcctgcagtatttatccatgatggaggcggaagggctgatctattccgatgcatatgatctgactgaaaagaccaattaccgttctaccttatgggggaccgatgagggagaagctccatcctttggatttatgacatacgactggattgcttcctccacttctgattctttaaatccggataccgttgtgattctgcctccggttgccaaggtaaacggcgcatggcagtattatctggataacggaagagccattaagccggacggctgggcaatttccgcagcaggttctacggaagctcagatccaaagggcatgtgcagttatggactacctttttacagaagatggaagcagattgcagaattatggcttgccgatgaacctggaagaaggaaagacatatacaggacctgatggattacagtatccgttatttaccagctgggtatatgaaacctcaggcaaagtggcaaaaggagatttatccacgttcttaagagactggatgggctgtctgatcccaattggatatcagaaagaaatcggttttgagtaccagtatacatctgaacggggatttgaaggctgggctcttctgcaaaattcaacaaccaattttgcaacttatgcgggaaaaggaatgagcggggataatgccaattattataaaatggtgccgccggtcttctccctgacttccaggcagaaagaaacgatttcagatacaacatcccttgatacagaggacattgtagaatacatgtttaatatcgtccgttaccaggcaaaaggcaatgcgcctcagggtgcggtagtggctaaaaactatgaagaatatgcggcagaatttaagaagcggggacttgagatttatgaagaaacctatcaggctgcctatgacgtcatgacattggataaacagtagttaaaccgggggaggggctttcccctcccttataaaaaggtgggagctgatgatgcagaagtgtttaaaaactcaaagattagcagcaggattatataccgggatcgtgatccttgtattcatttatactctttgttttatgacagagtataaggacttgttcggactgaaattaaagcagaatgatcagatttccttttttcatgattacattctgcaggtatttaataaacagatttttgcctttgcggtatttggagttctcgtgattttactttcctttctgctggagattttcggtaaaataccggacaaatttgctttaattatcatggagctgtcactgtttctctgctgcgcatgttccgcctatgccttgtttaaccttcaggccatagaaacctattatgggggactggatttccaatatctgcggttggagagcgcgggtgattatgagccccattttaccacattccgaatcggactgggaatctacatttcctatattctctgctgtgtttattacagcgctgccattggcagaagccattttaaattccggaagaatcagaagaaggggagtacaaggaatggataatcggttgcttgaaaaagaaaaaaaggcatacgtgtcattatataaaaaggatgtgctgccatattcactgatcctttgtgccatattggctgaactcatctatgatattatggttctggatgttatgcctgtgagctacttaatgggaatcacggtaatgattaatattgtgatattgtttctactttttacctgtgccgtgaaggtcagtatctatcacaaaaaatgggccgtcattgctgtctttctgggtatatacatgctggtcagaatgtctgtgctggtcccccttgtgctgaagccatatgccaggcacacggaaattgcagcagcaaatattttcggaggaatcatacttctggcagccggctttatcagcttgaagcatgggaacagaagacaaaggcttcaggaacagctaaagcagtcagaagccagctaggacgaggtgaaaggtatgggaaaactccggtttaataatataagtaaagcatatgcaaatggattttgtgcggtcagcagcttcaatttagaaattgaggatggagaatttattgtccttgtagggccgtcaggctgcggaaagtcaaccatcctgcgcatgattgccggactggaaaaaatatcggatggagatctgattctggatgataaggtcattaataaatgccctccggtggaacgggatattgcggtggtgttccaggactatgcgctgtatggcaatatgacggtttatgacaacgtggggatgagcctgcgggtcagacatgaaaaagacacggttatttatgacaaggtacaggaagcttccggaatattagggatcggaagcctgttaaaacgcttgccaggacaattgtccggagggcagaaacaaagagtggctttggccagatcggtggtaagaaagccaaaggtatttctcatggatgagcccctgtcaaacctggatgcaaagcttagaacaagtacaagggctgagattgtaaggcttcagagagaactaaaggttacgaccatctatgtgactcatgaccagacggaggccatgacaatggcagaccgtatggtggtcttaaaagacggggtgatccagcaggtggggaccccaatgaaatttattatgagccctgcaatttatttgtagccggttttattggagcgcctcagatgaatttcatcgaaggcagggttgaaggcagccggtttgtatttggttcccatgagctttcctttccccagaagattgcggatgccttaaaaacgtattccggcagggagctcatattaggaatcaggccggagcagttttccatttcccatggggaagataacaatacggttgcaggagagttggagaacaaagaatttttaggaaactgctatattttgtatgtaaaaatcggagaatcggtcctggcatgccagattgaaaccctggaggacaaatttgaccatcgggtcaatatccactttggaatggaacatctctatttttttgataaggagacaacagaattagtaatgcatgcaaaggcggaggagaaggatgagtaaacagttaaccggtatagcaaaagcgattattataatttcttctttggtgcatctgatttttaccaatattcatgtaaaggccctgcttctcctggaacatgagatgtgcggctttgtgatgtttctgtttgttctcatggggctggttgccctgtttgaaacaacccgtatcaagaaacgggaagtagcggaacgaatctttacagcattgatatgttttgtaacagcaggcataggattctatctggtcactatttaccggaatgcaatttctgtacagcactcccttaatgtgagcgtggtaaatcatggggtattgttcagtatggcaatccttttggcttatgtaatttccggtatcctgattattgttgatttaataaagaacgggtgaagatcatgacgggcagagaaaagaaatatggaaaaaagaaagtctcggacaatgtgaaagcaggaatattcaggtggtggatcgcaggcatgtgctacttttttattggatttggaacacagtccggcatctttgccgatccgctggatatgatttttttccttggactgggattggggcttgcaacattgtttctttataatccggtcgcttaccggatgtttgatatagtgagaaaaggaggatttacaatcaatcctattttgagcggagcggctggcagaatgcaggtttaaaactggctgaaatttttaaaaatctggttcttgtgtttttggtttacatgacctatcaaaacgtaaatatgctgttggaggaactgtttcaccttccggaaggcacggtcaccataccgggagaacccattggctttgccgcggtttacaccatctattattacctgctgaccggattgatggatacagcggccgaagcgaggaagaaagaggagaaatagagacatgagcagtcttgtatttattggtgatttaaggccttataaagaacaggccaaaggagtaagaaaaaagcagtatgaaagactgcttttgcaggcagaccggtatgagtcatatcaattgcctgcacagcatccaaaagagagcaccacgtatatggggattgcaattatgaatcttgcccttgcataccgcttaagcggagaggataaatatctgtttgaagcaaagcggtttattggagctgttttgtcctatgagcaatggggaaacgcccatctggttaatgtggatttgtctgcttcctggatcttatttggactgtctttgggatacgactggctgaagccgtttttcgaagaagaagaaaaagagaaaatcctggccaagatcaggcatcacgcggatatcatgtatcagtacaaactggatacttatggtcacggctggtcaaccaattattatcagaatcacaactggatcaatatgaccggtctggcagcggcaggatatgtgctttcagagacttgtgacaaggccattcaatatatagaggaagcaaagaagaatttttccagagtattttcgctcctagcagatgacggatcaaattatgaaggcgttccctattggagatacgggggaatgtggctctttgtatatgcccatctccttaaggtagaagaaggcgtggattattttcatacaagcaattatctgaagaataccttttattaccggttatatcaatcctgcggtgattttgagcagcagatgaattttggagacagccatgaccgccacagcggacatgctccctgtgtctattataagacggccgctgagtacggggatggctttgcccagacctttggaaatcttgttctggatgaattcctcatggcggaagcaaaaataagtaaaattaagccgggcattttaccggaggctgtatttgaatttttatggtatgatcccggagtttcagaaaagcctctttccctcctgccaagagtaaggttttttgaggatttaggcttgctgtccatcagggaagactggagcagaagcagtaaggtcctgaccataaaatgcggctgtcccgggggcagaaagcagtggatgaacggctgggatttataccgcaaggaaggtgtggaatgcctttccctttcccaccatcatccggacaatctttcttatattttcgcaaggggaagtgaatatctgacctgcgaagacggatataaccggaatatcatgccggataaccacaatgtaattctggtagacgaccggtatacggatgcagtggatgtcaatgacgtatatgtgagcagcgccagaaaaaggctggaaaaagattcttcttatcccattgaggaaaaataccggggagaagtggtttgctttaagctggatgattccatggtcatttataaaggcgaaacctccgggatatatccggaagaacttggaatgaaagaggtaagccgtcttttatttaccgaccagttattcttttttctgttcattgatgtgtgtgtgtctgataaggagcatatttaccgtattatttctaatacggatatgccggcacagaagcaaacggatcattcctattattatcccatggaaagcggaggcatcacatatacggttttttcagaccaggagatctgttcaaaccagtacacccaggaggttgtcagtgttatgacaacccaggagccggataagctttgcagatctttcctcaatacgctgtcatttcaatcggcttctcctgtaaaaaggcagacgtttatagaatgctttacttttgatggaatgaatacggaagtttcctttgcaggaaaggaacttcatgtcaaacacggagaaagagactacgggttaaactttggagatgaaatggccgtggttttaatagaggtttgcagcaagaacggagaaagaaaaagttaccggattccgtaaaacaggaaaaagcgaggaaaggaaatgaagtatgtaaatgacaggttttatgagctgatgaatgcagagggctggaatcaggagctgatacaggaaatgaaaaaagaggttgatgaatttctcccctgtttttctgactctccggaccggttaagccggtggggtcactactatttctgtgacgatgacggaggcaggctgatctttgatttaaactcgcccggcagacatcggtgtgaagtgtgcggcaaagtgtttgaaagtgagattttggacggcgtatgggtttatttttaccggaataaagcagtgatcatggcactggtatctgcggtcatttataaagccacaagggaaaagaaatactttgattattccgtgtcagtgatggaattttacgccggacattataagaagtttcccttacataataaagaaaacttaatgggagattcctatgataccatgccgtggggctgcggcaaaataatgccccaggggttaaatgaatccattgttgccatacgttttgctcagatcattgaaattttaagagatgaattaagcccggaatttctgcacctggtatataacaatatgtttcgggaaatgtatgccctgctggctcctcaggcaacaaggatccacaatatcagctgctggaatctatcggccatcggcgtcatggggctggcattccaggatcaggagatgattgatttcgcattcaccagtgagtttaatatcagaaaacagctggaaacaggagtgaccaaggattgtttctggtatgagggatcgattcactataacttctttttgctggagggaattacttatcttttcctgttcagtaaagtttacggctataattttggaaaatcagggactgaagttttgcagaatatgtttgtacaggcatataattatgcatttgacaatcaattcctgcccaatcccaacgatggctggcccaatctgaatttgcgcacattcagttatatctatcacacggctgccagggcaatgggagaagacagtcccatcggcaatctggtgaagaacatagaagcatctgattccgttcgtacggccctgcctttgtcagagccctattattgcagcaacagcgtctgcctggaacagctgctgtttaacattgactttgattatcagaaattcattccggtgaaacagcgttcacacaactttcctgaatccaattttgtgattttgagaaatgccggctggaatgcgtttatgaaatatggactcaatgggaaatcccatgcccacccggatattatgaatgtggaactgatgtatgggaatcacagaatatccagggatttatccaatgcgggataccgtgcccgcctgtgcaatgaatggcacaggaaaaccctatctcataataccgtttgctggaatggaacggacatcacctcagtaagtccgggagaatgcctgtattatgatgaaaataaggttactgcagcggttaaagatgtttatgaaggtatgaactataccaggacaatacagattacagaggattcctttattgatgatttttgggtggaaagcggaaaggaaggaattttcgattatgtgttccatctggaatccgcccttaacctggagtatgatctggatctggaagatgcatccctggggtttgagaaaaatggatatcagcatattcttgaaacgaaaagagtgagaacaagagaggatcatgttgttttgcatgccagtgtggaagaagtcatgtggagcatatggatcgatttgaccggaaaccacgaattatatttattaaagacaatggataatccggtgaatcaaaggagaaatacgattttacttaggaatagaggagtctccccccattatcatctgaaaatagaggcggagacaaaacaataatgaaagcttagaaaaggagagtaaacatgagagcagtcatcacaggaggaacaagcggaatcggcttaagtgctgcaatggagctggggaaggccggttatgatattattatcaccggaatcagccatgaggacgcagaagcagcacaggagacgttaaaaaagcaagggataaacagcgaattcatttatgcagattccatgaaggaggaagacgtcaatcattgctttgaaaaaattgtccagaaatatgattccctggatgtgttagtgaataacgtgggaggtcttggggaagacagcgttttgaagaaatggagacttctttcatgagaaaggtcatggcacttaactttgacagcgcattttttgcaagccgtgcagctattccgctgctgaaaaaggggaataacccctccattatcaactatagtaccattgcggttacctccggcggaggacccggtgcaggaatctatgcggcaggtaaggctgccattgaagggctgacacgggcgcttgcaaaggaccttgcggaatatggaatccgcgtaaatgccgtatcaccgggaactattgacacggcattccattctgctacaaagcgtgagatattagagtcctggaaggaaggaattcttatgaagaggcttggagaaccatcggaggtggcaacagtgatcggattcctggtttctgaaaaggcttcttttattacgggagaggttattcagatcaacggcggtcaggtattcatctgacgaagcagaaaggaagcggtgagatggttttaaaatatgaagatatcattcctacgaacccggagccggggattaccagacgcattcttgcaagaggcggaagcatgatgggggtagaagcttcatttaaaaagggagctgtcggaagcgtacataaacatcctcatgagcaggtcagctatattgtatccggttcatttcagtatgaagccgatggtataacatatatgctgaaggctggtgacagctattatgtggaaccggatgtgccgcatggtgcaactgcactggaagattctgtgatcctggatatctttacaccccaacgggaggattttgttgtggtggaataagtgcttgcaagcattaaatggcaatattaaaatttaatatagttttatacatgaccgataggctggcaattttacatattgccagcctatcattattgatttaattgagcaaatcccttgaagttataggaaggtggttattttttaggaggagacacggaagtctcattaataatcgttctgttcagatcaaaagctgatttataacgttcccccatagcttgtgataaagagtagtatatcgtctcgataatgcacatgatcggcagcctgaaagaaaagtggttatcatgaatgttggatatatttggaagtgcggctaataagatattgcagtattttgaaaaaggagtgcccatgtaattggatataccaattattttgtgtttattgctgtgtattttatcggcaataagcagtacatcccggttaacacctgactgtgagacaattaatgatatgtcattttctttctgcatggaaattgacatatggtgataatatggatcatcatataaaacgcattttaaacaaaggcggaatagaaaatcataggcctcgcgcgcaagtatggcggaagtaccgattccataaatatgaatggtgtcagcctttaagatcaaatcggtagcctgttcaattaaggaatagggcagagtatttaaaatttcttttaaagcagaaatattggaattaacaacatttgttagtgtattcatgtcgttattctgggtgacaggtattgtcatatgttcagtagggtttgtctgttcggaggcaagggatattttaaagttcttcagaccgctgtagcccagcttttttgttgcagcaatcactgtagaggcagcaatatttgtagcttcagccagttcagtgatggacatatagatgacctttgctttgttaactaatacataatcagcaaacaacttttcgctgtaactgagcttattataattatcaattatattcttcgtgcagcttaccatgtaccttatcctccaaatactgtattagtcagaaaattccgaattatatttgcaaaatttacatcattgtttctattgcctttttgtatattttatataataatgtagtggaaagcaagggtaaaataacaaaaataaataaaatggagggttattatgaagagaagaattgcgtttttaatgagtgctgtattgcttgtttcttcattgacagggtgtggaggaaatgcaggaggttcagctggtagtacgtctgcggctcagcagaattctgaagcaaaagagacatcggaggaaggacaaacaaaaggaagtttatcgggaaaaacactcagagtcggcacgatgccagtaaccataggggtccctgtacagtatgcttatgataagggtattttgatgaagctggattggatgtggaaattgtactgttcgcaacgggagctcctgtaaatgaggctatggcagcaggagaaattgatgtggcggtcagtggaatggcttccgtctatgcgctggctaccgggctgtatacctatataggggacgggagtataactctggatggcgaagcaatttatgcacgcagtaatagtgatattgttaaggaggaaggtgtgattccgggtaccaagggaagtgcagaaaccgtcagaggaaaatcgattttaggacctcttgctaccactgctcattttatggcaatcaaatatgcggaatctttcggtcttacatcagatgattttacaatgatgtcaatggaatatgcacaggcttatcaggcatttatcatgggggacggggatctcctggcaaccaaacccccatatacctcccagttggaaaacgaaggatatgtgagagtgtgcggcatttcggaggcaatggggagccccatggtcaatgctatttatacccaaaattcaatttttgaggacagacaggaggatttaaaattatttttagactgttattacagagcatgtgaagaactgaatcaagataaagatctccgaaaggattattccatgaagtggtatgaagagaatggtattacatttagtgagggagatatggaagatgagatcgaaactaaaatatatcatacgttaaagacgcttgatacggaggaatatccatttggatttacaatgatgagcataggtgaattctttatggaacaaggcatgatagacaaagaaaatttgccaaatatcaaagcctgcatgaatgacagcgtgataaaggagctgaaagcagaatccggtaagtaatggggaaatgcttattgtggcaggctggatagaggagtgaaaagcacatgaggaaaaataaatatttgttgatatcggttttatcgctttttacggtggttttaatctggtatctgtgcgtggatgtgtttgggctggtccggcagtcagtttttccggggccggttaaagtattaggaacatttattacaaaaatgcatcataagaatcctgacggagcaactcttgttcaacatttgtttgaaagcctgaaggtgtgtatgcttgggtatggcctggctgcattggtgggaatcccgttaggtatcatgatggcctggaacatttgggtggacaggctggccaggcccttgtttgatttgatccggcctgttccgggcatagcatggattccgttatttcttttaatgttcggaataggaattttttcgaaagcatttgtgattttcctgagcgctttgattccatgtactgtgaacgcttatacaggaatcaggcaaaccagccagatacatctgtgggtaggggatatattcggggcaagcaggatgcagaaattatttaaaatagcaattcctactgcattgccgatgatatttacaggactgcgggtcgcagtcggttcggcatggaggtcgttgattgcagcggaactgcttgcatccaacaaaggtttcgggtatatgattcagcagagccgggcattgtcaagaacagatattattattgtgggaatgtttgccattgctcttgtcggttctttgcttgatacgctgcttagattgatcgaacgaaaagttgcgaaaggaatgaatgcagtatgaaaacaaaacgggatacacttctttctgctgtcgcggcctgtatatccataggtacatttatatttgtgtggtatattgctacaaatggaactacactggggcagtttatatccggtccgggagaggtactccattctctggtgaacggaacaatgggtaaagtcggaaaacacagcattgccgtgcatgcggcttatagtcttcagcgggtaatggtggggtatgttctgggttcggcggccggaattttactaggacttctcatgggctggtatccggttgtcaaagctgttttctggccgttattcagtattatcaggccaataccctcaattgcatggatacctcttgcaattatctggtttgggcttggagaggaagcaaagatattcattgtatttatatcatctttcgccaatttaactttaaacgcgtatagcggagcaaggagtacgaacaaacaattgatcggtgcagcacggatgttagggctgggcagcttcaggtgtttttaacaatcgtacttccgtcctcggttccgcagatatttgcagggcttcaggttgccatgtccagcgcatgggcaactgtaatggcggcagagatggtccgttcgtccgaaggccttggctggatgatcgtaaccggtatgagcaacaataatattaatcagatacttactggtatcgtagcaattggaattgtaggattcatattggcggtactgatgagaaaaacagaggaggtattgtgcagatggaacaagggcgcagtataaccaatcatataatcgattgcagtaagctatcaaaaacgtataacaatcacaaagagagtcaggaagttatacataacatagatttatcagtcggagaaaatgaatttgtggtaattctggggccgggacagtgcggaaagagcacattaatcaatttaatgtccggcctggaaaaggccacctccggcggagtgactgtatgcggaaaaaaggtcgatggtccggatcctgaacggggagttgtttttcagagcatttccctgttcccatggcttacaaccatgggaaatgttgaatatggcttaaaaatgcgcggagtaagaaaaaaggagaggcagaaaaaggcgcagtattatattgacctggtcggtttaaatggatttgaaaagtcatttccagtggccctgtccggtggaatgaggcagagagtcggtattgccagggcttattgcatagaacccaaggtattgatgatggatgagccgttcagcgctctcgatgcccagaccaggtacttaatgcaggaggaacttcagcggatctgggagattgaaaagcgtaccattctttttgtaaccaataatctggaagaggcgatttatctggctgaccggattattgttttaagccgctgcccttcacagatcaaaaaggaatatgtcattgatttgcccaggccaagaaattatgtttctcccgaatttttagcattgcgtaaggaaattgacgatatcatggattcggcgaactgatggagggacgagaatgaagacaaaagtaaaggtaaagaatctgaccaagaaatttggggatttactggttctcaatgatatttcttttgatgtgggagagggtgatttactgtgtgtcgtaggtccgacgggatgcggaaagaccacttttctcaacagtctgacaaaaatctatgaagccacatccggagaaatattattggataatgagccggtaaatccgaggaaacaaaatatctcctatatttttcagggggattccaccatgccgtggcttactgtggaacaaaatgtaggttttggcctggatattaaaaaggtttcaaaagaacgcagagttgaactggtgaacaagtatctggatatagtcggtttgaccaaatatagaaattattatcctaatcaattgtcgaccagtatgctgcagagagtcggtattgccagagcatttgctacggagcctgatcttttgctgatggatgagccatatggacaattagacatggaactgcggttccatctggaggatgaactggttcgcttatggcagataacaggaaccacagtaatatttattactcataatatagaggaagccgtatatttaagcaaccatataatgattttgacaaacaagcctacttctgtgaaaagaattatggataataaattgccaagaccgagagatattacatcgaaagagtttgtaaatctcagaaatgaagtaaccgaattaataaagtggtggtaggcatcttcaggaaggaacagataataatggacaagaaaaatgttttattgattacggttgatcagtggtcaggtaattacctggggtgtgcggggaacaatgaaattttaactcccagtctggatgaattggcccgctatggaatcagatattccaatgcggttagtacgacgccggtatgcattccggcgcgaagggaattgatgttgggtgtaggaagcaaaactcatggggaccggaaatttaatgagtccttaccaatgcccagcgatattccaagtatggcacaggtattcagggataatggctatcaggcctattgtgtcgggaaactgcatgtatatccccagcgtgacaggatcgggtttgatgatgtgcttcttcatgaggaaggccgccataaagatgggatggctcaggatgattatgaaaggtttcttgggaggtccgggtatgccggtctggaaatgggacatgccatgtgtaacaataattatttttacaggccgtttcatcttccggaggagtatacagtaaccaattgggcggtcagaaatatgtgtgagtacataatcagaagggatgcagccaagccttcattttggtatctctcatttgcagcgccccatccgcccctggtacctccaaaggattatctagatttttatgaggacatggattttgaagagcctaagtatggagagtggacaaaacgtccggaagaagaattgccgtatgcttataattattataaaaatctctacaaaatggaaaaaaagagagactcagacatggctaagaaggcctattatgcctcttgtacctatattgaccaccagcttagactggtgatcggaacactgcgtgagcagggtatcctggatgataccgtgattttgtttacgtcagaccatggggaaatgttaggttctaatcatctgcacggtaaattccttatgtatgaaaattctgtaaaaattccttttatattgtctccgactgcagacagcggcatgaaatgcagcacagttgatgacaggattgttgaactaaaagatgtaatgcccacactgttaacacttgcgggcctagaggtcccaagtcatgtggaaggccggtctttaacagaagaatgggatcgggaatactcctatggagagttatgggaggatgaccgggcaacgcgtatgatccgtacaaaggaatggaagttgatttattactgtacaggaaatactttccagttgtttaatatgaaagaagataaggatgaactgtttgatctggcagatattccggagtaccaaaatgtaaaagaactgctttctgagaaacttatggaaaatctgtatggccaggatctgaatttgcttaaaaacggaaaacttgcagggctgccgccaaagaagtatgatttcaatgccagccttgcagacgggaataaattatttcaggggcgtgatatgcttctgcagaggggcattcgataaaggctgacagcagtcatttaaagcctatggcaatgaagttatgccctgaggtggtataaggttaaaagaaggctatccagtgaatgggtagccttctggctgatggtaagacagatgtaaattgaaagtgggatagtaagatgagtggatatttatatgtgttattttttgcggccagctttttttccacagttgcaggcaccgtctgcggaattggaggaggagtgattatcaaaccggttttggattcctttggtttaatgagcgcttcgtccgttagctttttatccgggtgtacggttttgggaatgagctgctgttcttttgtgaaaagtaagatatcgggagactctccggtatccgggaaaatcggactgccgctggcagttggagcagctttgggcggagttttcggtaaaatgatgtttcagtcaatgtcagatgtgtttacagataagaatatgatcggagccgttcaggccgtatgtttacttgtgtttactgttgggactttgatttatacgctcataaaagaacgtataagtacccatcagattgaaaacagggtttcctgccttatggtgggattgattctgggagtcgtttcttccttcctgggtattggaggagggccgattaatttggtggtactgttttactttttttcgatggaaacaaaggccgctgcccataattccctatatattattatgttttcacagtttgccggcttgatcagtacattggtgacaggctctgtgccggaatttcccttcctgcttatggttctcatggtgacaggtggtgttctgggcggagtgggaggacggtcaatcaacaataaaatgagtgctgatgacgtggataagatatttattgcattaatgattgtaattattggaatcaatgtttataatattgtaaaatttttaaaatgaatcatatatattttgataaagcctgttatgctacattatgtttatacgttctcaatgcatctgagctgaaagggtttatttcaatgattccttgacaatactcatataattgctataatataaaaataaaattcaatttcaaatttagaggtttcgtatggcagagagaggcagatacagaacaaaacagcaggaaatcattttaaattgcctgaaaaagcaaagatctcgcttccttacagtggatcagtttatggactgtcttcaggaagaaggagtgcaggttgggcagacaaccgtatacagggtcctggagcgcctggccgaagagggggaagttatgaagctccccactgaagacggctccaagatacggtattgttatgctgataaggaagaactgaacaaaccggggaaattagtatgcctgaggtgcggccggttcatcccccttgaatgttccaaaatggctgattttttagaacatatctatgaggaacatggttttgagatggatgaacagcacacagtcttatatggctattgtgggtgcggcaaagaaaacagctctaagtcccagggagtctgagagtgacagataaagtcaatgatggcgaaagccggattgaaacgtgacagtgatgagtgctgagaaaaaacaggtgaagattgtcagatctgcacaggattaaagtgagtccggccgcggtgcgcctgattataagagctggccgtttattgaaattacagacatgattctaaaaatacatctttataccaaggcctgtttatctgccctgtttctttaattcacctaaaaatacccctaaataattgatctttttgatgtagaaaacgaaaatactttacttcttctgcaaaagccgggaatctgactgttatccacaccccaatgactgcggataaccataatggcggcggccaaatcatagaataacatattgacaatacgaaaaaaattgttataatatgaaaatgattttaaattccaaattagcaaaccaggaaaggaggagacgaagtgagctgttttacgaagaatagacgaatctatgcatttcttacagcgttttttgtgaccgctgtactgcttctctccgtcctttttattgtcacgcatgtggaacatgactgtacaggcgagggctgttttgtctgcacggaaattgaagcctgtgtttgcaccatctgtttattggcagaagccgtgggggcaggagccgttgttatctttgcatatagtgcaattcaaaaactcttatcttcttatctggccggacgttatttgtgcccggtttctttggtcagcttaaaaatccgtttagatgattgaaactttctcataacaaaacagaggtcacaccattaaaaacactatctggaggattattttatgaaaaagaatttaagtacaacattgggtacgctggctatgacggcgtttgtttcggttgctatgctttcgggctgctccggaacagcatctgtgacggaaacttctgatacggaaaatacttccgcttcagcagatgtaaatgaaagcccggctgcggactccgccaaaggtgaagagtcttccgctgcaacgggagaaaaggattctgatggcaggaaactgaaggtgatggcaagtttttatccagtgtatgattttgcagtcaaggtcggcggtgataaagttgaagtgattgatatggttccgcccggcacagagcctcacgactgggaaccggcagccactgacatcaaaaatatggaagaggctgatctgtttgtttacagcggcgcgggaatggagcattgggtcgatgatgtgcttgccagtctggaaaataagaaactgttgtctgttgaggcatctcagggagtcacccttcgggaaggccatgaggaagaggagcacgaagaggaagaagaggatgaccatggccagtatgatcctcatgtgtggctcagccctgtaaatgcaaaaaaggaaatggaaaatattaagaatgcttttataaaggcagaccctgacaaccaggattattatgaatctaactatgaaacttatgcggccaggttcgatgaactggaccaggaatataaagataccttatcccctctgccaaataaggatattgtagtatctcatgaggctttcggctatctttgcgacgcttacagcttaaatcagatagggatcgaagggctgtccccggattctgagccggacccggcaagaatggcggaagtcattgattttgtaaaggcaaacaatgtaaaggtcatcttttttgaggagctggtaagcccgaaagttgctgaaaccattgcaaaagaaacgggagcgtctacccaggttttaaatcccctggaaggcttaagcgatgagcaaatgaaagacggcgctgattacttctccgtgatgagagataacttaaaacagctggaagcagcactgaaataagacagacaggagtattgatgatggatgccattgcagttaaggaactggacttctcctatggaagcacccaggtactgaatcgtattagttttaccgttgccgcgggtaagtttgccgtcctgctgggacaaaatggagcaggaaaaagcacgctgcttaagctcatgctgggtgaacttactcttaacggggcagacgggagtatacagcttttggggcgggatatccggcagtttaaaaactggcaggagatcagctatgtcccacagagcggcatggcatcctttcaaaactttccggcctcagtagaggagattgttcaggcaaatttatacgcccggatcgggcggttccggtttgccggaaaaaaagaaaaagagctggtcaggcaggcgctgatccaggttggaatggaaaacctttctaaacggctgatcagccggctgtccggagggcagcagcagaggatcctgttagcaagggccctggtaaacagtccgcagcttttactcatggatgaaccaacctccggtatggacgagaaaagtacggaagatttttaccggctcttaaaagatatcaaccgtgaacagggcgtaacggtgctgatggtcactcatgaccggaaacgtctggagccatttgctgacgatatctggattttggaggacggaaccatgaatctgattaagacgggtcaggaggagaatggcaatggagatatttaattatgcattcatgcagcgggcctttattgtcgggatcctgctggccgcggtcattccctgtatcgggattgtgattgtattcaaacgtatgtccatgattggagatgccttatcccatacttcccttgccggagtggcggcaggactgatctttggaatgaatcccatagcagccgcagcggccgcctgtgtgatcgcctctcttggaattgagtggatccgcaggaagctgcccagattttcggagatgtcgattgccatcatgatgtccgcgggaatcggcctggcaggtgttttgtcaggatttgtgaagaatgcggccaacttcaacagctttttattcggcagtattgtggcaatcagtgatacggaactgtaccttgtggtggcggtcagcgttgtggtgctgcttatgtttctgctgatgtacaaagaattattttacgtgtccttagatgagcagagtgccaggctggcaggggtgccggtccggaccgtgaactttatatttacaattttaattgcagtgacggtttccgttgccgccaggacggtgggagcgttgatcgtatcctccatgatggtggtgcctgtggcttgcgccatgcagttcgggaaaagttaccgccagacacttttctatgcagtagccttaaatgtcatatttatgataatcggactgtttgcggcttattacctgggattaaagccgggaggcaccattgtgctggtaggtgtgatatttttaatactggtgtttgcaggaaaaaggctttttaagcggaagggataacaggaaaggcaaaataatctgtgcagccggcaaggcagcagaatggagtgcttatgactgatatttatattatatccggatttttgggtgcgggtaaaacgacattaattaagacaatggtccggtccgtattcagggataaggaagtcgttgtgattgaaaatgattttggggaggccgggattgacgccgggctccttagagagtgtaatttgacggttaccagcctgagtgcaggttgtatctgctgcagcttaaccggtgactttgaaaaggcagtagagagaattttgaaggattacgcgccggatgccattatagtggagccgtccggtgtaggaaagctctctgatattgctaaaatctgtttaaagcaggaggatgaaggcaggcttcacttaaaaaggactattacagtggcggatatccgttcctttgataaataccagaaaaactatggtgagttttttgaagaccagatcgcctatgcagatttgatcctgttaagccatcaagaggaatgtcccgataaaatcacatacatagaaaataaaatccggcagatcaatccggaagccagaatcgaggcaggcttctgggattccatttcccctgctgttttccggcaaggtccgcggggcagcaaaatttttaagctggagctggaggctgctgtgtctatgaaacctgtgaagatcagaggaagcctgcgtaagaacaatgaccagaaaatgggatttttaagccgccactttgccagagatgttttctccgccgtcacgctggagtggaaggaacccctttcagaagatcagctgaggaagagagtgcttcatgttgtggaacatgcggatggagtaatcctgcggggaaaaggaattgtggcaaacggttctcatggtcttattttccactttgtgccggggagtctgaacattgaacctgcaaatgcagcaggaaaccaggtctgcttcatcggtaccggtcttgatgatcggcagatacggacattattcagtgaggggaaatagcatgaggacacctgcatgggtcataaccggtctgctggattcgggaaaaaccacactcatcaacaatctgattgaaaaggaactggatgagctggatattctggtccttcagtttgagtcaggggaaaagcctctgaaagaaaatacacaggtgaaaaagctggtgttttccaaacgccagctggaacaaagccctttcagcgttgctgatacagtaattaaggatttggatgagcgcagcccggatttaattctcattgagtggaacgggatggaacacttccataagctggaggaaatgtttctccagttttctgctaaaacagctgtaagcattgaaaaggtcatctatgttgcagacgacaccggattgaaaacaaaaattccggatgccggtgtaatcgcattttcacagattgcgggaagcgactgcgcctttgtcagaacaaaagggcatgagtatcttacagatgatatggggattctttacaactgtaatccggatatccggatctatactgaccggaaatgggatcggtttattaaaagaatattcagtttcagaatgcagccagggtcctggcttctggcagtttcaactgcagttctggtttatatggtggcattatcactgctgaatggccttggatttccggtggggcggtatgtcagcatatttcttggtgtctttttgcaggctatcccgtttctggcgattggggttttgctgtcctctttcattcaggtctatctccagccggactggattcagaggaaattccccaggagaattctggcaggccagctgtttgcagtgatagcggggttctgcctgccggtctgtgactgcgcatccataccggtttttaaaagtctggtgaaaaaaggagttccaatgcctgccgcggtgacgtttatgctggtatcccctgtgatcaatccggtggtgattctctccacctggtatgcttttaacggaaattaccggatgattgccgccaggtgcggtctgggaattctgtgtgcggtgctctgcgggctgacttatttaatagcgcctcccagggattatctgcttgaaaatgccatacccgttttagcaaactgcggggactatacccttcctgccaaagaagatacccgcctgtcccgtttctttctgatgatccggcatgcgcagaatgaatttttttccgtaggaaaattccttctcacaggaatttttgtatccacgctgttccaggatatgattccttccgccgtatcggccggaggtgggatggctgcatggaaagcgcttctggtgatgatgggaatggcctttgtgctttcgctttgctcctcatccgatgcagtggtggccagaagcatggcgggaagccttccggtgggggcaatcgttggatttctggtatttgggccgatgatggatattaaaaatgccgctatgctgctttcaggctttaagtccggttttgtggtccggctgtttgtgaccgcatttctggtttgtttcctggtaattgcgctgtttatgttctgggggagcggagggatccggatatgacgttaaaaggaaaaggactcaaccttcaggtgctggcggaatgcgtctgttacctgattttcggatgtctgctatttcatctgacttattcaggcgggtatttaagctatgtgacgccaaggatgaaaccttatctttatgggctgtccctcctgatgtttctctgggcagtggcggaaggacgaaacttactggcaccccagtacaaggcaaggctgtcccgtctgtttgttttaattattccgatcctggtgctttctatcaggccgccggcccccggagggagcagcatggccagaaattacaatagctccggtatttccatgtcatccggaaacagaggcggccagataacaggcggtacaggacagcagacaccttcgccagacagcacagggccacaggaaccgccggggaacggagaaaatgatccgtcgcagtctgactgggaaggtgcggaaaccgacgcataccaagagacggatgagtattcaaaggatgatgcttcacagacatatggagaagaaggtcccaatgttttaaacggtctggatgaaaaagggaaaaccataaccatagcagatgaggattattatgggtggctgcaggaattaagttcctccactgaaaaatatgaaggttatacgattgctatgaaaggttttatttaccgggatccagagattgaaaaggaatgtgactttgcgctggttcgcctttccatgtggtgctgcgcagcagacttaactcccatgggctttttggtcgattacgatggaaagctggaatataaggatgatgactgggtggtggtaaaaggtacgattgatttaaccccagatggctcttccattatcatgaaggcccaaagcattgagccggccgaaaagccgcaagaagaatatgtttatccatacttttaaacgggaagaataaaagctttacagggccatgcccggaaaggaatgattatgagagtaaaagtaacattggaatgcacggagtgccatgacaggaattatacggtcaccaaaaacaaacaaaaacatccggagcgaatggagatcatgaaatattgtccaaggcttaaaaaatatacgcttcataaagaaacaaaatagaaagaggagaaaagatgaaaaaaataccggttactttattggccggatacctgggggcagggaaaacgaccctgctgaatcatattttaaatgatcctatgggatttaaaattgccctgattgtcaatgatttaggcgcagtaaatgtggatgccaggctgcttaagaacaatgggatccggtataaaaaggaccagctgctggaactgaccaatggctgcatctgctgcagcctccgggaagattttattcacggaattgagggcctggcactggacggcagatttgattatatactggtggaagcttcaggggtcagcagtccggctaatatagcagatgcttttgaagaggaaggcagtgaatttccggccaggctggattccattgttaccgtggcagatacaaaccggatttacacggaattcatggatgagtttaaggagtacgcagcatcggatcatggcaacggccaggaagaagaacaggacattattaatcttgtgatggagcagattgaatacagcaacatcattattcttaataaatgtgacttactgacagaaatgcaggtggagaaggctgcagagctgattctcagcctggcaccggaaaccgagatcataaaaacatctaacggccgcgtggattccggcatcatatttaaccgtaagctgtatgactatgagaaaatgaatcaggcgtctgttctctccagggcatggtcaatgggagaaaacagtgactatgaaccggattatggaataaaagctttctgctataaacggaggaaaccatttgatgagcagaaattcgatgcatggataaagaatcattaccccaaagagatcattcgcgccaagggatatctgtggtttgcgggggatgaagaccatggagttttatttgaacaggccggtaacagcattgccatcactccgggagccaggtggattgtgtcttatccggaaaacgagagagaggaactgctggaggaatatccggaactgctggaaggctgggatgagaaggacggggacagggaaaatcaggttgtttttattggaagaaatatagatatagagtctctgaaccaggtactggattctttcttaaagaatccttgacagcaggcaaatagcgttttctataaagtccgagaaatgggcaatagaaaaccacccttgtatacctggtaggttgaaagggtggagttttctatcgttttgacggccaaccccctgtattggggcggttgttccttatgtaattttactatagcatatctggcagcaggattcaaggaaaatatatattgtccacactatatatggcagacggtatatagctgccggaactgcattcttattcagatcgttctgattccacgcacatatcaatagcctttttgatgtaaccgtttaccgattcgcctatagagacagcggttgcagcaatctcttcatacttttccctttggacgtcaagagaaatacgtattaatttttcttttgtgtattgcaagttatattcagttttgtttttgttatctattccttcactgtgttttactctcagatacatggatctgcggtcaatcaaagattattctttatctgacagaaaacgcccgaatattacatgcttgtaattgtttaaaaaactaagcaggatgtttccaaggaccccaatggcaaggatttcccctatacccactgtaatcatggcgtaccagatgatatcctctgagccataggcataccggaggacccatgggatgatgatggtatttgccaaaatcgggggaacgcataccagccacctgtttttccgaagcttataggaaccaatcgctccgatgagggtcgcaaggctgccgaaaatcacatccagggtggctgctccgcacaataaattagacaggaaacatccgataaacaatccgggaatcgccgccggggtaaaaaatggaagaacacagagcatctctgagatcctgaactggatgggaccaaagctgacaggtgcaaaaatcatggtcagcacagtgtagactgcggcaatcaccgctgaaaagaccataaaataggtcttctctgaatttttgtaatgcatattcatttctcctttagttttgttttaggtgtggaaggtctcgaacacaccggtctttacctgcagacgttcctgaagatgtagaaaaatcaaggggtctgcgaccttattgcagaaaaaagtgtatcacaaaatacatgaaaaggcaagcagtgccaagaaaaagccccaaatgataaaatatcatctcgcccctttatccatttatcccacaaatgcctttgatattgatatcatttcctccgctttcgcattccaactctgagatcctctgccccgaaaatttccatctaagtgccttcactctcataataccagcctaccctttttcttatttttcctgcacggtaaataacattaatagacaagatcctttgtccaatatcataaaattaaggggagggttacaatcaatatataaaatttacacaaaaataccggatgtaaccaaaatgtaaccgccttggtttataataacatcataacaaaaggataatggtgacaattatgataaaaggaaaagtcagtgtggttcggggaaccgaccgatatattaccattgcagtggatgaatgcgatgattgcggcattaagggaattatgtttcattgggatgatcctaaaggaatccaattcagcagtatgctggagatgattttaaatatggacagagtacttgattccatgagttgtccaaaacagacatttcaaatgcgtcattttcagggaactaatccttctgatcttgtgactcggatcagtgaggagaaggaacggcagggaaaacggaatacatttcgtatatacgtacggtatcgttaccatgccagctggcaggggttgatcgcctgggacgaaggagatcagcaggagccgtttgaaagtacgcttcagatgattcttatcatgaaccgaatgctgaagggatattcccaggcgggacaggaaggggaaacattgaattccttccatgtcgccattgatgcttatgattccggaaggattgtgggaaattaccagaatatctctgcagaccttacagaacagcatgatattccggctgatttagcaggaaccctggggaactttatggaaatcagagccttaaaggaaaaattttcaaaatacggcctggattacagccgcctgatttccaatgaggtttgctccatatgcagaagaggtggacaaaaggcaaccttttccattaagatcatgtttcgtgagcattctacgtggcagggcattatttactggcgggaaggcagggtggagcagtccttcaggagtttcaaggaaatgctttatttaatggtatctgcagtagggacattaccggcaagaggcgaacgttatgaggaagaggtgacgcccattgccttagggttataagaactgtgtcataaagtgcactttacaggacataaaatctgtaaggtgcatttttttgattataattctagtgtagattttctcggtgctttcttatataataaaaaggaaagcagttgcctttacggaagaaaagctgtaaaagtaaaggaagacattaattattacataaaacaaaaattaaggatggaaaaagcatgtatcaaattgattttcataaaccagaggcaattcattttattggaataggcggaatcagcatgagcggtctggcagaaattctcattgacgaaggatttaccgtaacaggatcagattcccaggagtcggagctgacacgccatttagagacaaagggtgcggtcatcgcatatggccagagggcggagaatattaaagaaggaattgacgtggttgtgtatacggcagctgtccatccggataatccggaatttgctgaggccaaagaaaaaggacttcccatactcagccgtgcagagcttcttggacagatgatgaaaaactatgaaaactccatagccgtatccggaacccatggaaagactaccacaacctccatgataacggagatccttttggcagccgaagcagaccctaccatatcggtgggcggaatcttaaattccattggcggcaatatccgggtgggaggtccaaggctgtttgtaacggaggcctgtgaatataccaatagctttctgtcctttttccccacaatggaagtgatcctgaacatagaggcggatcatcttgatttctttaaagatattaaggatatccgccattccttccgccttttcgccgaaaagcttcctcaaaacggaaccctggtgatcaacaatgacattgagagcagagaagagatcacagagggactgccatgtaacgtgatcacctttggcaagaggccgggaagcagatatcaggcagaagccatacgttttgatgaactggcaagagcaacgtttgatttaaaggtggacggaaatgttgtggataccgtgacacttggcgttccgggagagcataatgtgtataattccctggcagcagcggcagtctgtacagaactgggaattgacttagagctgattaaaaaagggctaaagcgttttaccgggaccaaccggcgttttgagaaaaaaggagagctgtccggcattaccatcattgatgattatgcccaccatccccaggagatcaaggcgaccctggaaacggcaaagcactatcctcacaaaaagctgtgggtggcgttccagccccatacttataccaggacaaaagcatttctggaggaatttgcagaggccctgtctctggctgatgaggtgatcctggcagatatctatgcggcccgggaagcggataatttgggaatcagctccggggatattgcggagaggatagaaaaaagaggggtaaaagcccactatttttcatcctttgatgagatcgaaacatttattttagaaaattgtatacacggtgatttgttgataactatgggggccggagatatagtaaaagtgggagaaaagcttttaggcttatagttatccacattatccacatagttttcaacattttatgttaagaaactatgtggattttttaatttacataatttataatcttacaatttataaaatctcggttttatcagcaaatcgacacgattcggaggagaaatcctatttatgtatacctggtttccacattatccacaatatccacaattcatttagtggataactgcggctatttccttttgctgagagttgtggtaagatatccacgaaagcaatgagcagtgcgaaaaagaacacgaagaaatttttcgtcgtgcctgcacgtaagaaaatttcttcgtgttctttttcatagggcgaatgcccgtgagcctgctgatcctgcgggtcagcaggctcccactgcggaccagtggtacgaaaaaagcgaggttatggcagtgaatattaagagcagtttcaagataaacgtaacggtaatatccaatgagttcattgacgaatacatggctgcggccaatggagaatacataaaggaatatttatatttgctgcgccatgaaggggaagaaatcaccgtttccatgatagcagatgcattaaaccatacagaagcggatgtgacccgtgccatatcttactggaagaacgccggggtccttaaagagattccttctataaatcaggcagcatctcccgcggtatctgagacagcctgttccggagtcagcccggaggaaccaaaaaagcccgggacaaccggccgccggatggtctattcgcctgagaaaatcaccagtcttgccggagatgaagatttttcccagctcctttatattgcacagaaatatatgaataaggtgttcacccaaagagagtgtgaggtattcgcctacctttatgacgggctccacatgcccgcagagctgttggaatatgtggtggagtactgtgtccagggcggccacagcagcatccgttatattgaaacagtggcaatcagctggcatgaaaagggatttaagaccatagaggatgccaagagctatgctcttacctttacaaaggattcctttgctgttatgaaggcttttggattaaatgacaggaaaccgggagacttggaaagggattttatggacaggtggttccgctcctatggatttaccagggagctggtggttgaagcctgcaaccggaccctggcagccacccatacgcccagcttccagtacgcagacaaaatactggagggctggaaaaagtcaggtgcacgttccatggaagaggtcagaaaactggatgagcagtatgcggaccgtgtgaagagcggggaacaaaaagctggaaagagcggagaatataagcagtctcagacctcaaagggcagaaagggacagaaccagtttcagaatttccctcaaagagagattgattatgatgcccttgtattaaagcagctgacggaacggcagtagtttttacataagacaccaggaggaatggaggtaattatggcgctgagcaattcacagtacgatgccatcatgcgggcatatggacagcagcagtttaagaaccggcatgagcaggaagagaggattgcggaagtatatcgtaaaattccggttattaaggagcttgatgatttcatcagcaccagtgcggtgaccagtgcccgcaggcttcttgacggtgacaagggggctcttaaggcccttagaaatgaaatcgcagacttgagagagcagaaaagcgtgcttttaaaggcagccggttttcctgcagattacatggagatgcggtaccgctgtcaggattgtcaggataccgggtatgcagacggggtaaaatgccactgcttccgccagtttgaaatgaaatatctttacgcccagtcgaacattgaacagatcattgcggtagaaaatttcaacacattttcttatgcatattttgatgatacaagagtggttccggtccttaaccggaccgtcagacagtatatgggacaggttgtggagacctgtaaaagctttgtaaagggatttgccgcagaccatgggaacctgctgtttacaggccctacgggggtcggtaagacgttcctgaccaactgtattgcaaaggaactgatcgaccggtattattccgtaatatacttatctgccaatgacttatttgaggtgttttccaagaaccggtttgattaccaggatgaagaggacatgaaggggatgtaccagtatatactggattgtgatcttctgatcattgatgatttgggaacggagcttaataacagctttacatcttcagaattgttttattgcatcaatgaacggcttaattcttcaaaatcaaccattatttccaccaatcatcccatcaatgagctgagggaccggtatacggagcgtgtaacttcccggctgatcagccgttatacggtgattcctctttatggagatgacattcgcatcagaaaaaaagaaaaacgtattgagtaattaaaatccaggaagcctttgtacgataaggctcctggattttcagttttctgtgttggctcagtttgactgtaagggcagcttttaaaggctggcgagccgttgaaaaagtctgttcacgtccacctgaccatatccccatatgttattgggataaatgaatgtatcgctgcgggtcgccccgctcactaagaggcggttgacattatttccggtcattctgggataattttccctgacaatggcccattcaaataccatggcaacaattccagcagcgtgggctgccgcggcgcccgtacctgttacagatccgtacatgtttccggggacagcacaggtaagctggtagcccggcgcagccaggtcaggcttgatctcaccggtccttgtatagcctctgccggactccggcaggatgctgttattcatgtcgttgtaagcggcaaccgtcagctgatgccttccgtttccgggagcggtcagggtggtatcaggatttgaattaaggaaatacgtctctcttgagattaagtctccggaaggcagccaggaatggaaagcaaagggttcattttcaatgttttgcacacgcaggtaccagatgccggggaggagattgttaaaacgcaaaaggatgagctggtctccgttttcctcctcaaatatgatattgttgacgtagatggtggtctggttaaatatgaagctgaaccttctgcattgattgaaggaggggaaaacaggctgggtagattcccggtttggagaagagatatcaatggaaagcctggcaggggcatatgaccagatttccatggaaaacattgtgtcactgctcccgactctcagttcaaaatcattgtagaaaggggctccggtattggcattaaaatagtgtctctgactgtttccttcattgccgccggaaacgcataccccgattccaggcagcaatgtaaggtaatcaatgtagctgtccaaagaacctcttccgtcatggcctccctggttgcttcccagggcaatgcacaccacaagggggcgtcttaaccgttcggaaatcataaaagcataccggattcccagtatgatatcggattcctgatagcagagggcattttcaggaacaaaaaatatactttttaaattttgttttgcttctttcagctttacgatcacaagatcggcctggggcactactccgctgaagaattgggcttcatccggggtaccggccagaacactggcaatggcggttccgtgtccaatggtatccgttgtggggacaagagataaagggtcctctgagcttaatgcctcattgatttgctccctggtgtattcggaaccgaatgtaaaggtttccggaggcgtaccggtttgtaccgtctggtcccacatggagaggatgcgtgaggttccgtcattatacttaaaagccggatgccggtagtcaattccggtatcaatgacagccaccaggaccccgctgccaaacagggccagataagggttcctctgaacagttgagatgccggacttttccagactggtggtggaggtaagcgtataaagtgtcgggaaattgttgtagggatggcggcctaaatcacaggggtccacggtggtgacaggaatgtgcagaagagaatcccttatatccaaataggtaatattatttccggtatcataggaaggagccagggtattgcttataatcaggtcataataattattatctaaaattttgggcaagatttatcctccctgcttttaatagtacataatacattttatgcaaagaaatatcgaatatgagaatctcctgaagccttggcttcaaacgtaagaaattagcggttgcaacaaatggaggcaacgattacaatgaaattaagagtcctaattgcatcgattaacttgactatttccgcgcataatgttataaaagaaccgttgcattgtattaggatacgttggaggagagaagaatgctttacgaagaaaagacgatagaaaccattcccgtgggtccgctgggtttgataccgttaaaaagctgcaaagagttgggagataaggtcaatgattatctggtgtcctggagacaggagcgggaaagcgagcacaagtctaccatcgctttttcaggctatcagcgggattcctatattataggagccagcaccccaaggtttggaaccggtgaggcaaagggcaccctgcaggaatctgttcgcggtgatgacctttattttatggtagatgtatgtaattacagccttacctattccctatgcggaatgaccaaccatatgtcccctgatgaccacttccaggatttgaagcgtctcattgcagcatcggcaggaaaggcccgccgcattaatgtgatcatgcctttcttatacgagagcaggcagcataagagatccagcagagaatccttagactgcgcgctggcgcttcgggaactggtgaacatgggcgttgagaacatcatcacctttgatgctcatgaccctagagtgcagaatgcgattccattaaagggcttcgagaccgttcagcccatttaccagtttatcaaataccttctgagggaagagaaggaactggatattgacagcgaacatatgatggtcatcagcccggatgaaggcggaatgggacgtgctgtattctttgccaatgtccttggccttgatatgggtatgttctataaacgcagggattacacccagatcattaacggccgcaatcccattgttgcccatgaatttctgggaaccagcgtagagggtaaggatgtgatcattgttgacgatatgatttcctccggcgaaagtatgttggatgtagccaaggagcttaagagaagaaaggccaggaaagtatttgtttgctccacctttggactctttaccaacggccttgcaaagtttgatgaatattatgagaatggatttattgacaggatcctcacgaccaacctggtatatcagacccctgatcttttatccaggccgtattatatcaatgtggatatgagtaaatacattgcgctgatcgtagataacttaaatcacgatgcctccttaagcgagcttttaaatccgactaccagaattaaccggcttttggagcgctaccgtgcaggtgacagataaagcgggacatatggaaaaattatcgaaacagaagctggtcttagtgggccttacacttttctccatgtttttcggggcgggaaatcttatttttccgccctatttgggtgcatccgcgggagtcaatacctggatcgcaatggccggttttgcggtaacggccattgggtttccggttcttggcgtggtcgctgtggcccggtccggcggtcttggtaagctggccggccgtgttcatcccggatttgcatttgtttttacactgcttatttatttatccatagggccgtgtcttgccattccaagaactgccagcacctcctttgagatggcggtagtcccctttttaaaagaagagagtacaggagcccttgctcagctcctttattccgcctttttcttttccattgcctttgccgtatccttaaagccggacaagttgacggacaggctggggaaaatactgactccgtgcctgctggtcttgatagtggtgatatttgcgggctgcatggtccatccggcaggcccttacggggttccggcaaagagctatgggtccaatccctttgtaaagggatttcttgaagggtacctgaccatggataccattgccgccctgaattttgggatcattatctccttaaatgttcgggcaatggggatcaaacaggaggcttctgtggtcagagagaccattcaggcaggttttatcgcaggagggatacttcttctggtatatagcgctctggcccacgtaggggccgttacaggcggcacattggggtctggggaaaacggtgcccagaccttaaaccaggcggtacgttttttatatgggaatgcagggcttatgatgctggccgtcattttctttatagcctgtttaaatacctgcatcggccttatcagctgctgcagcaggtatttcagcaccattataccgaaagtgggctatcgtgcctgggccttcctttttgctctggtaagcctgataatctccaatatcggccttaataagatcctggaagtctctgttccggtgttaaatgccatctatccggtagccattgttctcattttactgtcctttggtttccgggatgaaaggaagtggaaggcggtttacatctgctccatcagccttaccggaattgccagtgtgcttttatcactggaacaggcaggccttggctttttaaatgcgggtctttccaggcttcctctttatgatatgggacttggctggatcgggccggcaatggcaggaattgctgccggagctttaattggaattgctgggaataagaatccatagaaaattggaattgtcagggaaataggaaccattaagagaataagagcatatagaaaaagactgtcatggagggcatagacccggcataacagtctttttatcgtatagggcgtgtccagcgaagctggatcacaccagccggtgcaagtccggtcacggtaattactagtgagccgtgtagctaaatccggtgcgttgcagtaatgcagggtgctaagcggatggataacatatctcttttttgatatggcaatcatgcagaccgtaacgtaaagtgaattctgccgtgtcgtaagtaaaactgctccaaaaaaggaggagagatggggaggttgagccttgcctattgtggcgaaaaccaaggaagatgggaagagactggaaaagcaccattgataatcctccggcatatgggaatcggtatgtatgaagggtgtggtccggaactggagagaccctacctgtcaccgtaaggtaaagatgagatgtataagtgagaacgaagtagtactcatgacaggagggagccagagaccattgggaatccccacagtcaaggacagaatcgtccaaatggcggtaaagatagcaatagaaccggtattcgaagccgatttcaaagactgttcctacggattcagacccaaaagggatgccagacaggcattggagacagtgagaaaggcttgcaacaacaaaggatactacgtggtggacgcagatattgaaaagttctttgatcaggtgaatcaggagaagctgatgatactgatagaacagaggatatgggacagagggatattaaagctgatcagacaatggttaaaggcaggaatactgtatggaaatgtactggaaatcagtgaattggggacaagtcagggaggagttatatcaccgttactggcgaatatctacttaaatgcatttgatggctggtgggaaagaaacgggagtaaacatgagaagctggtcaggtatgcagatgatagtgtgattatctgtaaaaacaagaaaagcgcagactatgcgatgaacctgttgaaatacatcatgtggaagctggatttaaccttacacccgaccaaaaccaaaacggtatgtttatggggaggaaaagaaggctttgattatctgggaatgcataacagaagattcagcaaaatcagaaaagaaggaaatccatatggggaactgacccagtatccaagtaagaaagccatgaaaaagataaaggaaacagtgaaagagaatgtcaaccaaagatatctgttggtcagaacggaggaagacttgataagaataataaatcctaaagtcatagggtggcgtgattactacagaaccaaaacagatggaaaacagacggtttagaattagaagatataaaacccttcttctcctaaatcgtcatcttcaaggtcatcgaattcatgaagaaagcaatccatatcgagaaggtcatcatcactcatatcgcgaacttcgtcacatgtcataccttccggtgaattttgtaagtagtgttcccgtagctcctttgcaagctcttcttctgttatccgtttcattgtaacctacccccgtacttgtctaagatatcatgattgtatcatgaaaacggaaggtatgaaagaaataaaagaagagcgggggaacggcacagatgcttacgcattgccttttcgtataattcatgcaaaggaacaggtctatgattaaaatataacttaaggaagagcatgacatttctacagatggaacattttaggggatcgtatccaaatgagtgaaggctggaatcccgccagcggttgaaagagagatatagtttatgtttttcttttaaaatagccctgcgaagacgcttgtcagaactgcgatgtttggcataaatgccgtagtaacgaatcattttaaaatgtttttccggtatgtgctgagtcaggcgcgcaataaattcaagagcaggaagagtttcaatcatgagttgatcatcttcatggcggttgtaatggaaggtaacggaatcgccgtcgtaagaatcaattctggaagtggcgatgacgggtctgcccaggtaacgtccaatgcgtaaatggagttcattaagcaaggctgtctgaaaagaatcccgaaggagtttataattgaaatgttttacatgctgccacaggagagaattaccaaccccaccttcagaaataagacaatggcgatgctgaacagaaataaccttaaaagacatggaagtagtcctgtcaatgatgggccaggggagctgaagtgtcgaagacactttttttcagctacagacaaactataggctggctacaggggaaacacagatgaccacaagttgaggcgtcatatacggcgggggaatcggtatcaaaaaggccgcttgtcttatgcgtgtgcttttttgctctggcagctgccgttggtttgctctggaacagtcagcttccagtgcgcaatacaaattccttgcttgaataacctctgtttattgagagcagcgccggaggggagtctcatgaaatggttgaagacgcaatgaaagaagctgtggataaagcggaataaagccccttatcccctccgggtgcgacgtagaactaaaacggctgtccggcggaaaatccgttgatatccggatttaccctgctctccaaagaatgtttgatgccgcaagggaggatggcatttatccgattgccttgtccggatacagaacggcggaaagagagcaaaaaatcatggatgaaaaaatcgaagtatataaggcggagggtattcccatgcagaggcccggaaggaggaggcttgggtggccgttctgggaacaagtgaacatcagcttggaattgcggtggacattaatggggacgggattcattcttctggaacagaggtttacaagtggctgaatgaaaacagctatcgctttggttttatccgccgctgtccgcccgataaaacagaactcacaggagtcaacaacgagccgtggcattaccgctatgacggcatttcggctgccacggaaatgaagcaccaaaacctttgccttgaagaatacctgaatccagaaaaatgagaaaaggaggaggttcatttcgtaagaataaaatatatattgaccatcccatttagatgccgggagagcggtttgtagcatttcaatggaactgcatatacccagagaacattttgaaatgtaaaaatggtaaaactgcccgccggtaatcaccttctcccggacccgccagagctatgccaggctgatctgaattaatacgattcggttactcaaccttatttaaacataaaaaatgtataaataaaaagcacaaaccaaatattgaatataattaatataataatatccgaataaatagagataaaacatacaaaatcactaaaacaaacaatatatatgttgacttgagaagtaccgtactgtataatgcatataaaagaatataagaaacagccggcagaaaattcttttaaagaaactatagacgcagaactataaaatggaggagagaatgatgaataagagaatgttgcaaatattcggtattggtttattcgcggcgctgacagtgagcggctgcggcacagccggtggtcagacggcatctggagataagacacaggaacaggctgcccagtccgtagatgcggctggtgattcgggggcgctcaccttctggtcgctgtttaccggtggagatggggaatttatggatgacattattgcggaatacaatcagacttccccggcacaggaggtaaagtctatcacaatggtgtgggatgactattatacgaagctccagacgtctgttgcggcggacaaggggccggatatcgggtgtcccacgtttccaggattccggagctggctgaactgggcgtcattgatccgattgatgattatatcgaacagctgggaataaaaccggaggacatttacatacagaccgagcttgagagcgtgacctacaacggacagatctatgcgattcctctcgatatgcacggcgagattttctgcttcaattccggtctggtgaaggaggccggaatcacgcttaacgaggccggtaagcttgagatcaacagtaaggaggagatgaaggcggttttagaccagctgaaggcggttgtgccggagggcgggtcgacgatcgctttcccgaatcaggggacacagccctaccgagtatggtactccttctacaatcagctgggcggcgcaccggttctgagtgaggacggaacacagcttacctgggataaggacaaggcgctggaggctctcatctatctggattctctttataaggacggatacattactccgggaattgatgatttccagggattgttcgaatccggcaaggcggggcttctgatcaacggcactgtggcggtggccaacttggaacgcctcgacagctttaactgggaagttcaggcatttcctgcggtctttggaaatggagcatgttatgtaaattcacactctctgattcttccgcataacgaagagcggtccgagacagagtccctggaagccgtaaagttcatgcagtacgcggctgccgacggcgcctacatctggaccggctcaggcaatattccggccaaccaggcgattctcaacagcgatgagtacgaaaaggttccgcacaggagcgattataaggcgatggcggaggagggcgtctacctgttcaagtcgttaaactattcatccattgaaaatggaatcattgaagtgtttaacaaggtgtggctgggagatttaactccggaggctgcgatcgatgaggcggagacggtactcaaagacaacctttcctgactgccataggaaaggggggataatagtggctcggaacagaaaaacaacaatagcggcaattgcattcattctgccatttatatcggtttacacggtctttaccatctggccggtaatacagggcatttatgtaagttttttcaaatggacgctctcgggaaaacagaaatttgtcggcctgcagaatttcaggaagcttctgaccgaccagaattttattcagtctctgggaaatacgttcaaattcgtcattattaccgcccctgtggtagtggtattcgcgctgattctggcgcttctggccaacagggagtggagagggcggcgttttttgcgggtggcatattacataccgagtattctgtctgtttccgtggcctcctttatggcaaaatacatcctgatgccctacagcggtttcatcagcgattttctgcacacattccatctgatgaatccgggtaccgagatccagtggctgcaggacaaagtgctggtgtggttttccgtcgtcggaatgacggcctggtggaccgtgggattcagtatgctgatctatttagccgcgctgcaggagattgacgctgcggtcatggaagcggcctccatcgacggggcatccccgtggaagaagttgatctacatcacgctgccgctcttaaaaccgaccacgctgatgatcgggctgctgcaggtgatctcatgctttaagattttcggacaggtctatatgatgacgggggcggccctgcgtccagcacaagaacgatcatacagtatatttatgagacggcatttgaaaaaaataatatggggtacggggccgccatgtcgtacgtcctcttctttattattgcgacactgtcggcgctccagctgaaacattcagggaaggggggagataaatgaagaaaaatacaattcccagggcgattatttctatcctttcggtcttgcttgcgctgtctatgctgatgccgcttatctggtccttcttcgtatccttgcagcgggagggaaaagccatcaaaaacgtgtgggactggtttgcgccgccctatatcgtgaccaattatgtggatgtatttttaaagagcaatgtgctcctgtggctgagaaacagtgtgatcgtatcggttatagcgacaggcggctgcgttatcatgaccgcgatggcggcctacgcggtggcacttctcgattttaaaggaagggatctcgttttcttctacctgatcctgggcgtcatggtacccggccaggccacgatcgtgccgctctttattacggcaaacaagctacgcctgatcgatacgtaccagggcctgatcctgccgcttcttgtaaattccatgaatttcattatcctgacgacctttatgaaggggctcccaaaggaactgatcgaggcggcccgaatggacggcgcgggagttgtaaccatctttttcaggattgtatttccattggtaaaatcggcgctgtcgacgatctgcattttttcctttgtcggcagctggaacgactacttatggcctctgctttgctccatgagcgagacgatttttacgctgcctatcggaattccgacgcttgcggggacgtactccgtggattttgtgaagccgatgacggcaaatatggtagcgagtataccgatcgtcattttatatttaatatttgaaaagaaaatagtacaaggaatcaccatgactggtgtgaaggggtaaaaatggaacaggacagatataacagcgagttagacaaccatgtgattacagacgtaaaattcaaacaatttcgggcgagatatccgcggctgcacggcaagaacgccaggcttgggattcacggctttggcgggacggttaagctggctcagatctttaccgacaaaggggcgagcggctggggtgcatacgagggggaacacggttccggaggattggtgaccggaagacgggtgagcgaagtcttccgcgccgattacgggattctggatcctgcctgcaagaccttcgatatcgcactccacgatctggcgggcaatattttgggaatcccggtgtaccagatgattcgcggggacgcggaaggccgggccaatgtctatgacggcgcaatctatatgaatgatctgattcccgacgagaagccggccggtgtggaagcgatcctgggagactgtcagtatgactacgatctgggatatcgaacatttaagatcaaaatagggaggtcgtaccagtggatggaacatgaggagggactgaagcgggatatcgaggtagtgcggagaatccatgagaaattccccacggttcgtctgatggtggacgccaacgacggctatacatacgacgactgtatccggttcctggaagggatcggggattgccccctggtgtggtttgaggaaccgttccgggaggaaaaggagctgtgcagtcgcttaaagacgtattttaaatacaaccgtccgatgacatggctggctgacggagagtcatacaccgatatcgatttgctgtatcggctgtccgaggaggggtgcctggatgtatggcagccggacattctcagctatgggtttaccgcctggagaaatctgatgaaggatatttcggcgaaagggtatctggtctctccccattcctggggactggtggtgaaaacgtgctattgttcgcacttggccgccgcttacccccaccatatcccgtgtgtggaggcggtgcttggggagtccgaaggggtggattattccggttaccgtatgacggagggagtgctcacgctgcccaaggaatccgggtttggcatccggctgctgtgggcggaagagtgtgaatgagcattgggctggtgcgggtggaggagtgtggatcattttccaccgggccggtggttctgtgcagccgtaatttctgcaattagtgcttgcatctcccagggataaaatggtaaattgtatacagagaattgtttttactgctgaaacaaatgacagggagtggtgttatggcgaagatcattgatttggatatcggaaataaggacgaggtatgcaaggtggcgaaggcattgtcgtcgcccatgaggctggatattctgaccatgttaaactgccggggtatgattattagtgagattgcaaagcagctgaatattcccccctccagcgccgcgcttcatgtgaaggtgctggaggaggccgggctgattatgctggaagagcagcctgggacgagaggggccaccaagctgtgcaaccggaagaaggacattgtgcatatagagctggtgggaaggcccaaggggatcagcgaggtggtatcggtggaaatgccggtgggctgcttcagcgaatgtcaggtgatgccgacctgcgggctggcaaatgtcgccgggatcatcggatatgaggatatcaccagctatttctaccatccgaaccgtgtcagcgccgggatcctgtggagctccggcggcttcgtcaagtacctgtttcccaacctgatccccaagacgcggcagccaaagaccctcatggtgtcgacggagctctgctccgaggcacccggatataatgaaaactggatttccgatattacgctgaaaataaacggctgcgactgcggcttctacaggagcggcggggattacggcggccggagaggccgtctgaccccggagacgaaaacgatcggcagcacacagtacggcaagatggtaaactggagaatcggtgcaaatggcgtatttatcgatgagaagaaggtgagcagcgtgaccatcgacgaactgcatattatggaacacgagtccgtggaggtctggatcggcaatcaggaggggattaagttttccgggggatttaatatctttgggcgtggattcggagattttgaccaggatattttgatgatatcggagtatatatagaaagcagaaaatgcaggacgccggacaatctttgatatctggcgtcctattgacatcttcttgaatgggaatttgaatgattcttagccaatattttatgaggattccaacggatatcgcgcgaacaagttagcaattcaggcacaggaggtcacaagaacaagatgttggaggaaagactgggtactggagttcgatatcaaaggtctgttcgataacatacagcactctcatttaatggaaatggtcagcaggcatacaaaggagaaatggatacttctctatgtggagcgttgtctgaaagcaccatttcaaatataaaaagcgaaaagtaagaagagccgagcattggccaggagagctagcaaagcgtgatagaaatctgtctgctcactggaagtttggaatactgccattggttggggagctgcaaagagaatcgaggatggccagagaatacgcttaaacggaaggctatatcaagattttagaagataatcaggtgatttatgaagaagtaaataaaaacaaataataattttgtattgcctttacctggtacaaaaccgcagaaaaatccgttggattgtatcaacgtaaaccagcagctatcctatgttttctaaaagataagagtctgctgcggaatttattaatcggatgaaggctgtcctcatatccgattgcgatcccagctactaccgacagttcgtcgggaatgcccagctccgcatgaagaatctcgggatactgtacaagacaccccgccggcatcgtcgaaagaccgtgttccaatgccttcagcatgatgccctgagagagcgcacccaggtcgaagaacgataatcccgccagattcttgtccatacataaatagataactgcgggagcgttaaaaaaattccccatcagttcccctatctcttttacagactctccggcagcggcgctcatatccgcaagcagctcctgcatacgggcatggtggacaattggcatttttgacatatcaagatcggcttgtggcctgttttgagtattgctcagaaataaccgcttgaccctctccagcgcatcgcctccggcgacgaaaacttcccatggctgggagttacctccggatgcggcgcgtgtcgccgcctccaaaatggttttaatggtgttctggtcaaccggatcaggcttaaaggacctgcagccgtgacgggcaaataaagcgtcagttacattcatttaaatacctccagaattttttttagtttgtacgggaagcacatgttttacttaggattggcgtatcacttctggttacagacatcttttccgttatgcccgccagaggcttcctcagataccccccaaaaaaatggtgtgaggacttatcaaagcatttcccgaacgaattttctgacagattcaatgtctgcggtatccggatggctttttgctatgccgccgattagtttaaacggccccgcggtgtcaaaacccttgcaggcgaaactgcccgcgattttagcacctgatttttttagcaattctacgagtggcgcgttattggactctgatttatggatcgtgaccctgttgagcacgcaaagcgtgcgaaatataaaccatcagcatagctcaacatcataaacttaagggatctttctctatataggcaggtccctttttatattgtaaaatatagacaggggtgccaatgaaagcaacctatatgaaaagattccaaacactttctcatgcattgaaaaatactgatctaatggaacgtgcaagaatggatgagcataacacattttcaagaaaacgaaaaatgccattagaggatattctattatcttgccttaccagaaagaggcttaccaccactttagaactccgtacatatttcaaacaaaaagaggatttgtctatggaaatatcgaagcaaggctatctgcagcaaaggaaacgattgaaccctgatatttttactcatttaaatgatcaatatttaatggatttttataattcttctgaagtgagtttatggaacggctttcttttacttggaattgatggaagcaaagcggaagtaccaaattcagaaggaaaccgattatgtttcggcaaaagtaataaccagcattctgaacaggggcaaatacgagcattagtaagtggtatgtatgatattttaaacggattctatttggatatcggggttgcacatatttccactagtgaaaccgaaatggcaaatgaaaatctggagcatttgaaagtgctagggataagatgcccgattttggtaatcttcgatagagggtatccagctatggaattcattgattttttttagaagaggcaggaatccattatttattccgtctttcatcaaatgattataaaaaagaacgtaatgaaatgaaatcgtctgacaaggcagtaacattactccatacatcacaacaccttacaaaaatccggcaaaaacatccagagagatatcagcatatgaaagaaaaagctaacacaaacacccggatatcaaagagctttcttcctatgggcaaggaattggcattaatgacgaatctttctaaacattacagcgataagcaactgcaggatttgtattataaaagatgggaaatagagaaaaaatatcatattttaaaaaataaaatgaaatttgagagtgtaacaggaaaagctacagtgtatgtgtatcaagattttcgtgcacaattactggtttataatatgatacaagatgtcaggaatgccgccaatgccaatttaagaaaaaagcatgcgtggaaaatatataagtatttcatgcaaaccaatgaaaatatagcaataggtttgtttaaagaagaaatgatcaaaattcttctggaaactgatcccttaaaaagagaagagcgactcatagaattacagggcgaaatagaaaaacatgttttacctgtaagagacttaaaaagcgctgaacggaagaaaaatatatcaaacaaatataaaaataatcagaagaatagtttttaaaatgtccatactatccaatttaagggatagtatgggcatttttaggaaaagtagattatgacttggataaactgcaatcataaaataacaaatattatttcaacagtaaaatttagtcaattaatgatctgaattagttaaatacttatcttaagtttatgatgttgcgttttacgggtggtcatgattaaaatattttatacggctaaatttctaccagatgataaggaatcaggttcgctgtcagcatctgggcctccctctgatggcaggtgaagatgatgacctggtcggaataagtgtttaccagccaccttagggctgtacggagcctgtcatcatcatacagcacaaagctgtcgtcaaatataaagggcatccgctctgtcccctcctggatcaaagtggcggctgccagacggagcgctaaatatacctggtccatggtaccgctgctgacctgttctaagggaaccagctttgtctttgtattcaaaaagacattcaggttctcatccacgctcatgctggtatagattccccctgtgatacctgcgattaagtctgaggctgttttgtttaaatataaaccaaaggaatcccggatggaggaggagaggctggtcatggtttccagggccaggtcaatggcggaaatttcttccctgatccggtcgttctctgtcaggatgtgctttaacccttctgcctgggtcttgcagtttgacagatgctccagctttttttccagctcccactggcttttctgctgcttttcaatggactccccgcagttttcctgcttttttgaaagttcctcaagctctgaagccttttgtgcgatgactgcttcggatttggaaacggcggagcataagcgggtaaattccgccatcctcgtctgaaacgcccggatcgcttcaggactgatctctgtatttcccaaatgcctggaaaggatctcctgcaggatcttggcgctcatttccatgtccttttggctgtgtctcagccgcaaaaacaggattaagccgatcagataaaagatcgtggcagtgccgataaaaataccaagcaaaaggaggaggtcaagcccatagtaggcggtaaaataatttgcttctcccagatagtaaaggacacctgtgccgcataaaagcagggtcgcaatgaccagggaaaggattgaacagatttttctcggttttctgttacaggctgccctggcatccatgtattcatcatagctttcctgagcctttgcctggcaggcgttaatggaagcctggtcggaaaaatggttgctggtcaatacctgcctgcccctggcagctttttgaagaagctcttccttttctttctgatgctcctccatggaattcttcagctgggaccggagcttatgatattcctgaatctgattttcatattccggagatgagatttctttttccgtgttgcggatctcacttaacaaagaggtgtaagtgcgggccgcttccggaaccatctgggattccagctcctttctctgggattttaaaaaggcggcggacttggtaatgttaagggccaggtttcctgttgtgtttaagtttgcaatgtaatttttaagttcagaaaccatgccctcatcggtagcgctttttaactggccgatgctgacggtgttaatgtaggctgcctcgcttaagccgcacaataagtcgtctaaaaatgcctttgtaggctctacttcccgtccggcggtttcatccacaatcttaaattcttttttatttttctgaaaggtccgttcgatccggtaaatgtgatccttatgctctaaccgtatctgcccttcataggtgccgctgttttcccagggctcatactttgtgtaaaggtcattccgggatgcgcggcctctctggcgctcaatgccgaaaagcattcccctgatgaacgtatggatggtggattttccggcctcatttttgccatatacaatgttcagcccatcccggaaggtaaggtttctgccatggaatttcccaaagccattgatatagatatcaattattttcatggggtcagctcctttcgtccgttgtgcgaagcaatgcgttgatgccgtaatgaagggcctttttttccacagggctcatctccggtttttgaagggcctgaataaagaagccgatcatgtcgctgggatgttcggcgaacaatgcggaaaagtcatactgaggttctgactcgtcaatgatttccatgattttaaaccgggtggacaacatctccaagtcaaaggaaatgtcaggatccctcatgccgcggatccgaaaacggaatatgttttccggtccccggttctggatttcctgggtgattttcatggcaagttccgtattggtagtggcagttgttacattgacggccagggagatgtactgaagctttgccattggaatgaactttaaggaagttaccatgcgggtcacttcgttgatctccccaaccatcatgccgtgctgccctgattctgtcttgtccagaggctctaaggaaccggcaaatgccatgcggttttccaaaaggatctccggccggtggatatgccccatggcgacgtaggaaaagtccagattggacatggcgcccttgtcaaaggggatgtggttggcgtcgccgccatggcctaaaagaacatggatgcgcccgttgttaggcacctttaaatggtcaaggcggttttccggaatctctgatgtatggtagctgaagccgtaaacctctgtattgatatccttaaagtaaacactttctaactcctctcccatgagataagacacattgggagcccaggtaaagcttaacagggcggagttgctcctgatgcggtcgtgattgccggcaatgatgaccacatggacctccggtatggtggaaaaaagatagtttacttcttttaaatctctggccaggggctgccgatgaaataagtcgccggaaataaagagacaattagcttccaacgcttttgcctggctgaccgtctttgcaaaggtatccttaatgtcctgataccgttccttgctccacggcttgtcgctgtccgggctcatgccccagtggacatctgcaatatgtatgaatttcattgtcattacctcgctggtcctctgtacaaatggttacagttcgccatgccattcatgatccggcggctgaactgaaaccgcaaattccctgccggtatggaagggaatttgcggtacaggattaaagttcgcagttgcctacggttcttgggaatggaatcacgtcacggatattggacattccggttaaatacatcacgcagcgctcaaagccaaggccaaagcctgcatggcgtgtggaaccaaattttcttaagtcaaggtagaattcgtaatcctctttcttaaagccaagctcatccatacgtgccaccagcttgtcgtagttgtcttccctctggcttccgccgatgatttccccgattccgggaaccagacagtccacggcagccacggtcttgttatccggattcagcttcatgtaaaatgccttgatctcctttggataatccgttacgaatacaggttttttatagtgctgctctgttaaatagcgttcgtgctcggtttgtaagtcacagccccagaacactttataatcaaattcgtcattgtgcttctccaaaagctcaacggcctcggtgtaggtcacatgggcgaattcagagttcaaaacatgatttaaacggttaagaagttccttgtccacaaactggttaaagaagttcatctcttccggagcatgctccagaacaaagcggatcacatatttgagcatggattctgccagttccatatcgtcttccaaatcagcaaaggccatctcaggctcgatcatccagaactccgccgcatggcgtgtggtattggaattttcagcgcggaaggttgggccaaaggtataaatgttgcggaatgccatggcataggtctctccgttgagctggccgcttacggttaagttggtaggcttttcaaagaagtcctggctgaaatccacagcgccctctgctgtctttggaatgtttgtcagatccatggtggtaacctggaacatctccccggctccctcgcagtcgcttccagtgatgataggagtatgcacatagacaaaatctctttcctggaagaactggtggatagcataagcgatcagagaacgaacacggaaaacagcctggaaggtgttggttctgggacgcagatgggaaatggttcttaaatattcaaaggaatggcgttttttctgaaggggataatccggtgtagaagctccttcaacggtaatgctgtccgcctggatctcaaagggctgttttgcttccggagtggcgaccagagtaccggtgacgatgatggcggctcctacatttaatctggatatctcagagaaattttccatggtgtcatgatagacgatctgaagtgtttcaaaataagttccgtcatttaaaacaatgaatccaaatgccttggaatctcttaaacttctcacccagcctccaaccgtaacctgggtattaagaagtgattctttgtctttatatatttgcctcacagtgattaaatccataatagcttctccttttacatgttcgcatacttattaagattatactgtatttcgagcattgattcaagggggataggtataaaaacgcaagatatggcttaaaatgtaaaagatttaaaaaaaagtagaaaaatgtcggaaaatgcacaaaaaattatagttataattcaaaattttgttcactattttccgaatatgtgttataatgctagtacaataaaattacaacagcgagaggtgataacgtgatcaagaaagagatgattgccatgcttttggcaggcggccagggaagccgcttaggcgtgttaacgcaaaaagtggccaaaccagcagtatcatttggcggcaagtaccgtattattgatttcccactgagcaactgtattaattcaggagtggatacggtgggagttcttacccaatatcagccattgcgtttgaacacccatatcgggatcgggatcccatgggatctagaccggaacgttggcggcgttacgatcctccctccctatgagaagagcatgggcagtgactggtacactggaacggccaatgccatctatcagaacctcgagtatatggagacttacaatccggactatgtcctcatattgtcaggcgaccacatatataagatggattacgaggtcatgctggagtatcataaggcgaataatgctgatatcaccattgctgctatgccggtgccgattgaggaggccagccgttttggaatcctgataactgatgagaataaccggattacagaatttgaggagaaaccggaaaatccaagaagcaacctggcatccatgggtatctacatattcagttggaaagtgttaagagaggcactgatcaagatgtctgaagttcccggctgtgatttcggcaagcacatcattcccgactgcttcgaatcaggagaccgggtatttgcctacgagtacaatggctactggaaggatgtgggaaccttaagctcttactgggaagccaacatggaattgattgatatcattccggaatttaatctttacgaagaatactggaagatctacaccaagagcgacatcataccgcctcagtacgtgtcagaagaggctgtcataaacagaagtatcattggagaagggtcggaaatctgcggggaagtccataattccgtcataggtgccggcgttaccattaaaccgggagccgtgatcagggattccattattatgagggagtgcgtgataggagaaaacgttaagatccagaaggccattatcgctgaaaatgtgaaaataggtgcaaactctgagcttggttttggggaatttgctcaaagcaaatacgatcccaaggtctaccagtccgatctggtaacagtcggtgagaactcgaccataccggaaaatgtgaggattggtaagaatacggcaattgtcggtgagacagcagcagaagattatgctgacggagagctggctggcggagactacatcataaaggcaggtggcatacgatgagagcgataggaattgtattagcaggcggaaacagtaagagaatgcgggaattatccaataaaagggcaatttcggccatgcccattgcaggaaattaccgcagcattgattttgccctcagcaatatgacgaattctcatattcagaacgtagcggttttgactcagtataattccagatcacttcatctgcatttaagctcttccaagtggtgggattttggaagaaagcaggggggattatttgtattcactccaaccataactgcagaaagcagtgactggtacagggggaccgcagacgcgctttaccagaacctcacattcttaaaaaacagccatgaaccctatgtggtcattgcggccggcgacggcatctacaagctggattatggcaaggttctggaatatcatattgagaaaaaggcagatattactgtggtttgtacggagcttcccggggagaggatatcacccggttcggactggtgaggaccaatgaagacggaaggatcacggattttgaagaaaagcccatggtggcttcttccaatatcgtatcctgcggtatttacgtcatccgcagacggcagctgatcgagctcattgagcgctgcgccatggaagaccgttatgatttcgtaagtgatattttaatacggtaccggaacttaaagagaatttatgcttataagatgaacacctactggaggaatatcgcttctgttgagtcttattacaagactaacatggatttcctgaagtcggaagtgagggattatttcttccgccagtacccggatgtttattctaaaatagatgatttgcctccggcaaagtataaccctggtgccgtggtaaagaacagcctgatatccagcggcagcattgtcaatggagtggttgaaaattcagttctgtttaagaaggcatatgtgggtaataactgtgtcattaagaattcaatcattttaaatgatgtatacataggtgacaatacggttattgaaaattgtatcgtggagagccgggacaccatccgggccaataccacccatataggtacaccaaacaatataaaagttgttttagagaaaaacgaaagatacacattataaggaaatgtgggggaaggggcttgacatgcagattacagacgtgagggttagacgcattgaaaaagaaggaaaaatgaaagctattgtatccattacattggacaatgaatttgtgattcatgacattaaggtgattgaaggagaaaagggattatttattgctatgcccagccgtaaggcagctgacggggaataccgggatatcgcacatcccattaattccgatacgcgggatatgatccagaaggtcattctggacaaatatgagaccacggcattggaaatgccggacgcagaggcattggcttaataagattttgaatccgcaggcagaaggttgattctgcctgcggattttttctattacagactctccgaaaatacaggatttacatgagactccttttagagttataatgtaaaaaatatttttttgaaaggtagatgaacatatgacaattaaaataggtattgcaggctatggaaatttgggaaaaggagtggagtgcgctatccgccataatccggatctggagctttctgccgtgtttaccagaagagatccggcctcagtaacccttctcactccaggcgtagaagtgtattccatggatgaagccatttcaaaaaaggataccattgatgtaatgatcctctgcggcggaagcgctgtggatcttccagtgcagacccctcttcttgccagacatttcaacgtggtggacagctttgatacccacgctaaaatccctcagcattacgaagcggtggatgaaacggctagggaagggaataagatagggatcatatccgtaggctgggatccgggaatgttttctttaaaccgcctgtatgctggtgctgttttacctggcggtcatgattatacgttctggggcaggggcgtgagccaaggccattccgatgctatccgcaggatccagggtgtaaaggatgccagacagtacaccattccggtggaaaaagcccttgaggcggtcagaggcgggaagaatccggagctgtccaccagggaaaagcatacacgtgaatgctttgtagtggctgaagagaatggggacttagataagatcagggaagagatcgtgacaatgcctaattattttgcagattatgataccacggttcatttcataagcgaagaggagcttaacagggatcataaggggatccctcatggtggatttgtcataaggaccggaaggacaggctgggaggatgagaacagccatgtgatcgaatacagtctgaagctggattccaatccggaatttacggcctccgtgctgacggcctatgcaagagctgcttaccggctgaataaagaaggccagagcggctgcaaaaccgtgttcgatatagctccggcttatttaagtgcattaagcggaagcgagcttcggggaaatctgttataaattcagaggcaggaggaatggaaaatggcagcgagaaaggaaatggttctgtattatcagcctgaaaaggacaagcagagcggaaatgatacaaaggccgccaagctaaaggcagttctgatccggatgggcatacggattaaaaatatttctccggatcagatgggccagaccataggatatctggcaggttttgacggttttgaagagataaagcaggaggaatgccctgatgtggaagaggagatccttgtgatgaagaatttttcaaacagccggatcgatgaactgctcttaaacttaaggcgggcaggtgtacctaaaatcgacttaaaggcggtaattaccgataccaactgcaaatggaaattccatgacttgtatctggagcttaagaaagaacatgataccatgtccgggtcataagcgtttggaaacgccgggagtaactgccggcagcagcatgatagaaaaccatataaaagtgcaaaaaaacgcgttttgaaggaggcttttacagcctgatcaaaacgcgttttctatgctaagaagctctactgataatcacaaacattggcccattgatgaagcagttccgcttcttccggccgtttttttgaaagctgggcagccgcaacaatgggaagccagctctgtacatatttctttgccgttccggtcttcttacaaaacaggttcatatacatatccgccttattctggtcctgcaggcagaacagcaggtaggttcttgccacatcggcactggcatttccctgggtcgcatgaacccagtccagaacaaacatggttccgtcatcctttaccacaatattactggggttaaaatctccgtggcataatttcgtatgcttgggcatgctgtccagctgtgtccgcatatcatatctggtcacatcgcctaattcttccgtgtccaggatctgccgtgacattttatccttcagcttgttaagtagcgggcactgctttgacaggatgtttaagtgaagatcaaccatattatccatgtattccggcagtttgtcaggattttcatccatgagctgttggagagtcttgccttcgatgaaatcaaaggtaatggaccatttgccttcgaaaacgccaacttctagaaccttgggaacattgattccgccgacttcttccacgcgcgcggtaatcaatgcttcattcaatacatctgcctttggaaaatcagcgttaaaaaccttgatcgccttatctccatcacgaaagacactttttgttgcagttgtagcaattaattctgctgccataagaacctctccttccatcaccattcgtctgaaccattatgtaatgattttgtacttatattttactacaaatccagtaaaaagtatagcttgttttaagatatatcaggaaaaaattactgaatatatctgatgactaaaaacggaaaacagctgcgccgtaagccggaagcttgtaagagaaagagtaatcctgcccatcccattctgtctttgcagagcggaaggaaggagccttttctccccgcttgtacagtccgtggctctcatctaaaaccagggtataggttccccgtttcggaacgccgacccggtaatcaggacgctctaccggagtaaagttcaagacaaacagtaagctccgcttatgatccttgctgtaccggataaagctgaagatgctgcgttcgctatcgttggcattgacccagtaaaaaccctcccagtcataatccttctcataaagtgccggatatttcttatacaggtggaggaggtcacttacataatttttaaggcttttgcctaaaggctcctcagataaataccagtccagggatgtcttttcatcccattcatggaactgaccgaaatcctgccccataaacagcagctttttgcctggatggcccagcataaatgtatatcccagctttaaattagcgaatttatcttccagtagtcccggcattttatggatcatagagcattttaaatgcactacctcatcatgggacaataccagtatatagttttcgctggtaaaatatgtaaggccaaaggtcattttgtggtggttgtatttgcggaaataggggtccagcttcatgtattcaagaaaatcatgcatccagcccatgttccatttgaaggtaaagccaagtccgctttcttcctggtctcctgtgacctttggccaggcagtggattcttcagcaatgacaatggccccgtttccccgctttttaatgacactgtttaaatgcttgaaaaactcaatggcctccaggttctggttgcctccgtactggtttggcacccattctcccttgcttcttccataatccagatagagcatcgaagccaccgcatccacccgcagtccatccacgtggaatttctccacccagtaaagggcattggcaatgaggaaattatccacttcatatttactgtaatcaaagacctttgtcccccaatccggatgctctcctttcctggggtccgcatattcatagcaggcctctccgtcaaagtctgccaggccgtgggcatccttgggaaagtgagccggaacccagtccagaatgactccgattccttttttgtgcatataatcaacgaaatacatgaactctcttggggttccataccgggacgtgggagcaaaatatcctgtcacctggtatccccaggagccgtcatagggatgctctgcgattcccatcagctccacatgggtgtagcccatttccaggacatagtctgccagctcatgagctgcttcgatgtaggtataaaacccatctttttcatccctgtttttcttccgccaggagcctaaatgtacctcatagatgctgaaaggttcatttagcgggtctattatcttccgcttttccatccaggctccatccttccagggaaatccggataaatccgctgtaacagaagcggtctgggacggtattctgcctgaaaggcgtagggatccgctttaaaaaggatcttgccgcttctggcggtaattgcatatttatacagttctccaatgcctaaatccggaacaaaagcttcccatatcccggaatcggcaaggagggtcatgggagttgcttccggatcccagccgttaaaatctcccaccactcctacctgactgacatgaggtgcccaaacggcaaaatacatcccgtcgtttccttcatggttttccggatgagcacccaatttttcgtagatttcgtaatgtcttccgttgttataaagataccggtcaacctccgtgataaaacctgttccgatttcatttctctctttttccatttgctcattcctccatgatctttaagataacgccccggttagccggtatggtcaatccgattctatggtcagtcactggaaatacttctccatcaagcagattcacggcagtatttccctcacaagggcagggtatagtaacaaatgcatcggccttatcgttattgaccgcagtgatgacggcccgtctttcctgaaaacgagcaaaagcgtactgccggttggttaggagaagctcctggtaccgccctccatgaaattccggattttcttcatggatatgtcccagcttgctgataaagtcctgaagagggcaggaaagctccctgatctcagaaaaagaaattctgggacgaagcatggagtcttccgtattggtccgttttccttccaacccaaactcgctgccataatagacagaggggattccgggaagggtgaatagcagagtataaaccggataaagatgactgggatcatgaagtttgcttgcgatccggttttcgtcatgattgtccacaaaggtatagagccgggagccaatggattccagcctctttacgttgtgggcgatttcaaaataattgtggtcattatgaccggaataaatgcttttatgtaattcataattagtgacagaatgcagcatctcttgattgacccatctgccgtattctccatggatgacttctcccatgagccagaaatcttccttcatgtccatggtgtgctcccgcagttctttcataaaacaaaaatccagcacattggcgcagtcaaggcgtatcccgtcaatgtcaaaggtattgatccagaactgtacggtatcaaataaatactgctttacttcaggattaaaaagattaaggcaaggaagttctaagtgtccctgccacccttcgtagccgaaagaatctcccagggggctgtttacggcaaaattaattccccggtaccattctctgtaaggagaattctctctgtgctccaggatatcctgaaatgcgaaaaattcccggcccgtgtggttaaagacgccgtcaaccacgaccttaatgcccgcctcgtggcagctggaaacaaactcctgaaaaccttccctgccgccgaggcggcggtccaccatacggtaatcacgtgtatcatacccatgggtagaggattcaaacagtggcccgatgtagatcgcattacatccaagagaccggatgtgggaaatccactggcaaagctctccaaaacagtctgcaacagaggattctctgttttcttttggagcgcccacaagccccaggggatagatgtgataaaaaactcccctttcataccacttgctcatatacttatcctccagattatagtagtttatacctcccggcttttgaaacggcgcagaaggaactgataacgcagctgagccgcgttaagctcgtaaatataacaatcaataagcgttggatcaaccacctgttcaaagtggtttctggcggcatcaatggcggttttggaacgttcaatttcatgtcttaaattccgctcttcctctgatggagccagatgtctttttaaaaggccatttttcattttatcatctccagacatataatttgcaactaaatgctataatttcagtatgtctggaaattggaactttattcataaattacctgtataacatttataatttatgaaacccggttcatcagctcctgcaaatactggccaagggaacaaagcttttttgtgctgtccccgatggttaaataataataattagctgtcccctcctggcggacacttacaaggcccgcatcttttaaaatttttaaatgatgggaaatggcaggccgggataatctggtcatctccgtaatttcctttacattcatcccctgccggggctgcagctttaagccgtcccccatgtttgcaacgtcgttccccaggttatcataaaggcccatacgggcgaggccttcaataatggacaggcggacttcatctcccagagcgataaaaatcggcatgcaattctggaaaaggtcgttaaaaccctcggcttgcatggtcgcatccctcctttggtttaaaaaagtaaactaataacattttatcatcctggcaggataacgtcaatgttttatcggcaaaattttgtgatttatgctgcgaaatttgaagaaaaagagaaaaaattgttgaaaataacaaaaatactgcaaagaattatctgattacaaaaaggcacaaaaaacatgtatacagcatttctataaaaaaacggttgacaattcacctccccttgtgcataataaaggcacattcttatatgcattccgcatacagcatttcaataattttcaaagaattatggatgactgattccataatcaaagctgattttccagcatgaattccaggttcagattttaagaaaagaggggattatatcgttcaatatgttattttgctgctgattttaggagcaggggcttactttgatgtccgtaaacaccggattcccaactggctggtgctttcagggatcatcatcggctttttatttgagatctttgggtcggggaagcttatggggagccttttattttccttaaggcttgtggctgtgaccggggcattctttttattgttcctgtgccggatggtgggtgcaggagatattaagctggctgctttgatatgcggttttctggggcttagagcgggcgctctggcagttggagctggttttcttataggggctttctggtcctttatcaaaatggcggaaaggggcattctttttacccgtcttatctgtcttcttgcctatatcaggcacatatttcaaacagggaaatttacaacctactacgatcctgtccgtgatggatacgatgtggtgatacctttggggctgtgtctgtttttgggtacgctgtgctccatgtttttctgaaaataaggaggttttgttttgtcaaagagagtgatggcggtttatgacgcagatcctttgtatacggagggatttgcagaatttgtaagcagaaaggaacagatcccgttttcagtcatagcgtttacggccctggagctgctgaaggcatatggggaagaccacaagatagagcttttgctcattgactcctccgtttcccgtgaggaaatagaaaaaataggagcagcctttgtggtcatgctggctgaaggggaggtggttttggcggagggacagtacccaagtgtctgcaaataccaggcagcagatggaatcatgcgtgaggtgatgaagcattactgtgacaatccaggggaagggggatatgccatggtttcaaggacaggcaggatcattggggtctattcccccataaacaggtgtttaaagacttcttttgcccttaccatgggacagctgctggccagggatttaaaggtcctttatatgaattttgaggattgctccggctttggacggctgatgggagaagaatacagaggaggcttatctgatcttttgtattattacagccaggagggatttcgatggagccgtcttggggccgttgtttatacctgggggatttggattatgtgcctccggtggaatatcctgaggacctttgccaggtgactgggcagatgatggcggacctggtaagccatattgcaggggaaagcacctatggatccattattctggatctgggccagtttggaaagaaggcggcagaggtgctggaggtatgcgatgcggtatacatgcctgttaaggatgactgcgtgtccgcggcaaaggtggaggaatttgaggaatacttgacatcatccggccgtgaggctcttaaaagcagaatccataagataaaacctccttaccacagcagctttgggcggagggataattatttagagcagcttttgtgggggaattgggagattatacaaggcagcttttgaggaaatacccataggctgcaaaggaattgtgcagggaggaacagccatggaagatgggcagagaaggaagctgcgggaagaaatcatgggagaattagatgaacggcagcaggtggccgatgaggagctttatgacatcatagacggacggattctggaatatggacaaagcagctttcttcccctgaaggataagatggagcttcggaaccggctttttgattccttccggcggctgggagcgcttcaggagctggtggatgaccaggatgtgacggagatcatggtaaatggggctgacatggtctttgtagagagaaatgggcgcatggagcagtgggcagggcctttgaaagccaggagcagttagaggataccatccagcagatcgtcagcagagtaaaccggacagtaaacgtatcaagacccattgcagatgccaggctgtccgacggttccagggtccatgtggtgctgccgcccatcgccctggacggcccttcggtgactatccggaaattccccaaaccaattaccatgacaaggctcttaaggcttggatcagtcacggaggaggctgtaagtttcttaaaatgcattgtggaggccggatacaatatttttatcagcggcgggaccaattcaggaaaaagcacgtttctaaatgcgctgtccgcctatattccaaaggatgagcggatcgtgaccattgaggattccgcggaattaaaaattacccatgtggcaaacctggtgcgtctggaaaccagggaggccaatggggaaggagatggggaagtgaccatcggggacctgatccgggcggctttgcggatgaaccccagcagaattatcgttggagaggtgaggggaaaggaggctctggacatgatatcggccatgaacaccggacatgacgggagccttagtaccggacatggaaacagtcccagggacatgctttcgaggctggagaccatggtgcttatgggggcggatattccgctcgcagcggtcagaagccaggtggcggcagcaattgatattttaattcacttagggcggttgagagataaaagcaggagggtcctgtccattgtggaggtggttggttatgagaatggagaaattaagctcaatccgttataccggtttgaggaagattacgaaggccgggaagcgggaccggccgtacagggaagtcttaaaaaggtgggaagccttcaaaacaccgaaaaacttaaagcagcaggcattgagatatgacgattatgtcctgacaccggctcagtggtgcctgtatggatttcagggcctggggcagcagggcttttcgcttacgtcttttaccgcagcattgcggcatttctgttatttcttccaatggtttttatttttcccataatcagaaaaagagaacaaaaagaaaaaaggcttcagcagctgaatctggaatttaaagagggcatcctgcttttagcttctttcctaagcgccgggtactctgtggaaaatgcgttctccgcttctgtaaaggaattggttttgctttatggggaggaagggatggtttcgaaggaattcacccacattgagagccagatccggatgaaccgatcggtggagcaggcgttttccgaatttgcaggacgcagcggccttgatgatgttaagaactttgcagaagtgtttgccgctgcaaaacgaagcgggggagagctggttcccattatcagccatacggcggatgtgataagggataaggtgcaggtgaggcaggagatcctgaccatgacagcctcaaaacagtttgaacaaaggattatgagtatgatcccctttttcattgtcctttatattgatatgacttcgcccggcttttttaacatcatgtacagtactgggatcggaaggattcttatgactctttgtttggttatttacatcacggccatagccattgcaaggctgatcatgaaaatcgaagtgtgaaaggaagggacaaatgtcaaggaaaagtgaaaaaaaatggaggttcccctttacaaaggcgcagacggcctgtgcagtttcagggattatcttatatgctgtcctggagctggtctttgcagcaggcggccagactgtttcggaaggaggcggacttaaacgggccgggccgggaagggcgagactacataccatgttctggtatccggacttgaccgggacaacggaaataaaaaggtaccggtgaaaataccggtcagggaacgaaaatatggggaggaagaggcaagggagctgtttcaaaggatccagcccgagctgatagagcagatgctgggggaaaatgaatctcttgaagaggtaagaagggacttaaacttaaagaacagccttggagattatgggcttagaattatctgggaatctgataatcctcaggtcattgattctttcgggatccttcataatgaggatataccggaagagggaaatccggtctggttaaaggccagagtcacagatggaagcaatgagaggagatatgagtttttggtgatggtttatccacctgctcttactcaggaggaaagagctgcagctgactttatccagtggataagcgggctggatcttaaacagcaaacagaggaccgcttatccctgccttcggtatatgagggaaacggctgacctatttccttcccggggagaccgattaccggatgctgcctgtgctgggttttttgcttgctgcactgctgcatgtaaaggaggagtttgacaggaaaagtcaggcaaagctgcgggaacagaaactgctttttgactattctgaggtggtttccaagctggtagtctatataggggcagggcttacggtcagggcatcatgggagaggattgtggccggctataaggaggcagcaaaacaggggaaaaggagtgcgcgcccggcatatgaggagatgatgaaaacagcggtgcagcttggcagcgggctgtcagaaggacgggcctacggcgaatttggaaggcgctgcggcttacaagcttacataaagctttctgctcttttggaacagagccagaaaaacgggagccgtcagctccgcccggctctggagcttgagatggcatctgcctttgaacagaggaagaacctggcaaaaaagctgggagaagaagccggaaccaagcttttgctgcccctgtttatgatgctgggagtggtcatggtcatgatcgtggttcctgcgttcctggcattttattagaagggaggtgagaggatgtcgatgtggataaaagggcaggtcatggattttttaagggaagaagatggaatcggtgtcattgaagttgtgttgatcctggtagttttaatcgggctggttattatttttaaaaagcagataacaacacttcttgagaacatattcaaagaaatcaacagccagtctaaagaggtgtattaatgcaaaaaagcggacagatcacggtgtttttcagtttggctcttttgtgcatattcagcctgatgtgcggacttttagagtccgcacggactgctggagccaggtgttatttaaagctggcggccgattcttccatggattctgtattcagcaggtatcataaggaagcctgggaaaaatatcgtctcttccttctggaatgcgggaatgatgaggaactggaaaaagcatggaaaggattcatggagccttacatggacagttccggctggtattccatggatatggaccaggcggatttgatgcagcttttccatatcaccgatggggaggccggtatttgaaacaggaaattctggattatatgaaatacggaatctttgaaaatattactgatgaagagggcgggaagctctgcttaagaatttaaaagaagcaggggccgtgaagcagctggccgggtccttccgcaatcatgagcgggaagccgtacgcctggaacgggcattagaggatatcaatgactctttaaagcagcagaaggcattctggcgggctgctgatgaaggaatcgggaattatgacggtgcggagtttcgaagggggctgaccgtctggaacaggagatgaaccggctcccttcccttgtaaaggcctatgggaaaagagcagatgatttaagaaagagtataaatgaaacaaacaatagcctttctaaggttcaggaagaattaagcccggaagtccgtgaggctttaaaaggagatacctcctgttatgaatcctatgtaaatcaggatggagaacggagaagggagattgagtcccttccagggaagatggaacagatgaaattggttatagaacaggcaaaggggcgttcttatgaggtggagagcatcatcgataactgggacagcgatgaggaagacgaggatgaaggtccggacttatctgccttgtggggatctgtaggagaaatatggcataaggtggacattccatccctttcctattccagcggtgtgaaggatacggaaaaacagaagcttctggaacaggtggaaggattcctgcagacaggacttttctccctggttctgcctgaaggaagtgaagtatccaaaggtattttggctgatgatttttttccttccgtcacttgtatggaggaacaggaacctggagtggaggcgggaattatggaccggattctgtttggggagtactgcggcggtttcctcacaagctttctttcagaggatgataaagagataaaatacgaattggagtatctggtttcaggaaagataacagatgaggaaaacttaaagcagacagttactgatattctcatgataagagaaggaatgaacttgatccatatcctgtccgacagccagaagagagaggaggcaagggttgttgcggggcttattaccggagctgtgggtctggcccctcttacgggtatcgtcgcattctttgtgatgagtatttgggctttgggagaggcgattgctgatgtaaagatgctcttagaggggaaaagggcggcctttctcaaatcaagggatacctggaagctgtcccttgatggccttttggaattgggaaggagtggaacctgtacgggaggaaagggggatgaaaatgggatggattatactgcctatttaaagcttcttcttttcataggagagaccgggcggcagtactaccgccttatggatgtgatccagatgaacctatccggaaaacagccggatttccgcatggtgcactgtgtttatcaggcccagatccggggaaccgtgaaatcaaggcatatgttttttggggaaatgatcccttttatccggtggaagtccggacagaaaaagcatattaagggacgttttgcgggcatacctttatgtccggtcaattaggcatgaaagaggaaaggaggcggatgatcatgccctttttcaaggagttccaaggaaaaaataataaaaataacgttactctccaggtacgaatccccttcatgaaacagggattccttgcaaaaagggtattatcatctgcccccttttcccgaaaaaacgggagcctgaccgtggaggcgtccatggtcctgcccttctttttattcctcatggtggtcctcatggttcctatgaaggtcatgcaggagggaaggcgcattcagaccgctttggaagcagcaggggaagaagtaagccagtatgcctatgtattacagcagctcaaactgggagaacggctggaaacctcaggaattgaagacttttcagaggaattcatggaagggctgacagaggaggggatccttctttacgtcacacgtcggatggaagggcgggctgtggttgagcggcttgaatcggtttcctttgcgcgttcttctgttttaagagacaatgagaccattgatctggttatggattaccggataaaaatccccttttctgtttttggactgaacagcgtaccaatgacagcaagaagctgccggagggcctggatcggccggaaaggaggaagcagcggaagggatggacaggaggatgagcttgtatacattggcaaagcaagcacaagatatcaccggcagcgaacctgccattatttatataatgatataatggagattccttttaaagaggtggaaaatgcccgtaattcatccggcggaaaatataagccctgcagcagatgcggaaggtttgcagaggaaaacggcagcgttttcatcatgccgtcaggagagagatatcacagtgacaggaattgctcttccattatgtcatatgcggaggctgtccccttatctcaagtcagccatttgggagcatgttcttactgttcacaataggaggtgttttaatgctggaaagcataagcaaaattttattcggcatatttctgctggcggccgcctgggaggatgggagagaaaaggccgtcagcgtatggctttttaaatcggccggtgcggcaggagtggtgcttgctcttttgcggaaggatatgggagcggagatgctgttaagctgcatggtaggagcggggctcctgttattgagccggttaacaggtgaggcgatcggcacgggagatgggtacttttttatagtcagcggattttttttaagtgcacttttgaacctgaagcttttgatatatggaacctttttaaacggcatcgtctgcggcggtatgtatatctggggcttgttgaaggggagggatgtgaagaagaaatcagtgcccttcctgccctttctggtccctgtctggattggactggtgatgctatgaagggaaagctgaaggggagctatacggttgaagcagcgtttgtcatggcaatcgtcttatgggcactgatcgtttccattcagacggcttaccgcctgcgggatgaagtggtaggagcaatggcgctggaagagactgcacaaaggctgcgccataacgagacggagcccccagatgaagcggcaatgtgggcggcccgcagggctggaaatcccttttcctggaaaaagtatgattttcagatcaaggtcacgggaaatcctgtaacaggcaggaaggtgaaggcatgggggacggcagggacctggaagctggagctggaacagggcgtgtttgatccggagaattttttaaggatgttgactctcgtcaatcaggaggaatgaaatgaaggttgcatacaggcgggaaatgaagcacaattatttgataatagagccggaagagtctggatatgacagctatgaaatacatatgctggcggcaaacgggatagatggactgttaaaattccaggcaaagcaggtggatgaccggaagctttattattatgaaatcacttcaaagcagcctttaaacagggtccttgaatatcatagcctgggcggggaagagcttaaaaaattgataggagatattggacacacgctggaaaggctggagcgttatcttcttaaggaaaagcagattcttctggaaccggaatttatttatgtagagccggagcagttttcggtttacttatgccttgttcccggaaggcagatgggatttccaggggagatgaccgggttgctgagataccttcttggcaaggtcaaccatcaggataaggaatgcgtggtgatggcctatggtctgtatcaggaaagccttaaagaaaattacgggatgaaggatcttcttgaaattgcgggaaaaaattgttccggcacaaaagacaaagatgaaaatgtccggcagccggaaatggatagtaggacggaagaaagttccgtcgctccattttcctatggtttagacgatttaagcaatataggtgaggaattgggagaaggaggtgatttacctgacataaaaaagaacgggccggtcttaattatcccggtcttagtcatgactggcattgctgtaagtctatggctttttttgggtatggaagggatccggaaattctggtatacagtgccgtttgcaggagttatctctgtctttgcagctttgaacttatgggagaaaaggctctggaagcaaaaggatacggtggtaaagcaagaagaggatagccgtcagcccggggaaagctatgactggcatataacatttgaagacgaaataaaggataaggctccaaaatatgaagcggcagatgaggagatgtttcagaccgccctgctgacggatacagatggggataagagtatccggtatttacgggcggttgggtctgatgcagaagatattgcaattacttatgttccctatttaatcggaaagcaggaaggcatggttgactgcatccttgccggagaggccgtcagcagaattcatgccaggatagaccgggaaggggaggaataccggatcagcgatttaaattccaccaatggaacgtcagtgaacgggcggatattagaaacaaatgagacggtggccttaaataagggggatgaagtatttattgcaaactttgcttttatatttacataatataaaagcaggccttaattttaagaatatcagccatttttcagaccaatgtgcatattataaacagttcggtcagattaaaaggtcctgttcaatttgacacatgttttggtattcctttggcgtaacccctgtttttttaaacggatggataaagtaacagatatctccatagtccgctgcattggcaatctttaggaggctggaaatgtgatttcacatttccagcctccctcgtttcataaaaatcatatatggtatactctataccggctttacgtcatccaccagcaaataataatatgtgctgctgccctcctggtagctttgaaatacgcctgttatttctatttcgctttcctgttccggatagtcatccggataagcgtgggctccgttccagataaattccaatccctgctgacagcaggcggtggcatctgcaatcacaacggcataataatttttctttgtgtcagggtcctggtaaacctggaatgatccttcggctttcaccattttccccatatattgttccggagataccatcatgttgtacacttcggaaaagaccatggtactgcttaattttgtcaggtcaatatcaacggagggtcgtcagaggaaccggtgttttcatcttcctgtaattgatctgtagggggctccgcaaaatccggaggataggaattgacgtcagtgtctgactcagcctcattgttttggggcaacggcagaggggaacccccaacggtctccttttcgcagccggtcaataccagatttaccataaaaaacattaaaacaactccaaagatacgcttcatccttttacacctcctgaaatccagcctataagtgaacataaggcaaacgctgcgatgtctgcggcaacaatggtggaacccactggcgttccggccagaatggatatgagaatacccattacggcgcagaaaacggacaggatagccgaaaagaggatcacggacttaaaatttttaaatatacgcatcgccgaaagagccggaaagatgaccagagctgaaatcagcagggagcctaccagattcatggcaagcacgatgatgatggcaacgatgacggcgatcagcaggttgtattgatccgctttaatgcccgtggccttggcaaaatcctcgtcaaaggtaactgcaaaaatcttatggtaaaagagaagaaatatggcgatgaccaccacggaaagcgcggcgcaaagccatacctccgcctttgacagcgtcagaatggaagttgacccaaacagcgtgctgcatacgtctcctgccaggttggcagaggcggaatatatattcaacaccagataacccatggccagagcgcctacagagatcattgcaacagccgcgtcccctttgattttggcattttgcccggtgcgcagcaagaggatggcacagataattgtgaccggcaaaatgagaagcatttgattggccagcttcattatcgtggcaatggccattgcgccgaaggcgacatgggaaaggccgtcccctatgaaggaaaatcgctttaaaaccagggtaaccccaggagagaggagcaaagggcgatcagtattcctacgatcagcgcatagcgcacaaagggatattcaaaatataaggttaatttttcaatcaatacattcatgcgtttcttcctccgttcccagatgcgaacgctttgcctatatcgctgtccaggtattcatctcttgttccgaagaaacggggatttccgatgtgcaggatatggctggcatattttacggcagcaccgatatcatgagagatcatgatgatggtgatgccttcttcattgagcctgcgtatcagttcatacatttccccggtgacctttggatcaaggccggaaacaggctcgtcaaggagaagcatttttcctgcggcgcacagcgcccgtgccagcaaaacccgctgctgctggcctccggacaattccctgtaacaccgccctgataaatgggaaatccccattttctccatattttcgcgggatagctgcttttccttatgattgtaataagggcgcagtccgcagcggtttaggcagccggacaagacgatttcccggacagaagccggaaaatccttctgcaccactgtctgctgcggcagatatccgatcccggcaggctgaagcccgttttccataacaatgcttccttctgatggggaatgcaggtgcagaatggctttcatcagtgtgcttttaccggagccgttttctcccacaatacaaagataatcaccgctgtttatggaaaaatcaagtcctttcagaaccgtcttcccatcgtatccaagggtgaggttgttacatgttagctgtgccacattgattcctccttttaattcaatgcatctttcagtacttccagattggtctgcatgatggaaagataggttgtgccattttccacatcctttgaagtagtggattgcatggaatccatggtacgcactgcctgatttttgtcctttgtattttgaacaatggtttccgcgattttatgtttggcaccttcaattgtcagcacgctgccaagcccctgttcatccacctttttagaaagaaaggcaatggtttcaaagctggcttctgtttcagccgagcagcctacaaatgcggcgtaataggtaagaccgtaatcatctgccagatagcggaagggaaaccggtcccaaacagcacggttttcagtctggcagagtccaccgtctgctgatagtttttatctaattcatccagcttttttccgtaggcatcagcatttgcagaataatccccggcatttgcgctgtccagttctcccagctttgatgcaatgtaattacagaaagttttggcatttttcagtgacagccagacgtgctcgtcatattccgggccttcttcgccttcctcctgggcctcttcttcctctgcttccattccttcaatcacttcttcctccttgaccgtgtcgcccaggacctctaaaagattgattaccaccatgtttttgtttgtggactctttgagagcatcttccacccactgatcggattcgccgcctacatagatgaacatgtcgcagtttgagattttaatgatatcatctgcagtgggctgatagctgtgtaaatccacgccgttatcaagaagcatggtgatatccgcatctccggcatggctgcccaggatttccctgacccagtcgtattccgggaaaatggtgcaaaccacactcagcttgtcggtttgaccggtttttgcagttgtgctgccggaacaggcggtaagagctcccgccatcataagtcctgccaggaggcaggcaattaattttttcattatcagaacctccaaataaatattaatttaaaaaaatgggcataaaaatacaaggaaggcggttgaaaatcagtttctgcctgaaaaatgggcagaatcctcccctggaaaattatattcaatttgtcagctttaccttaagagaaaccagagtgtgtgaaggattgcggcggaataccggagttatgcagattaagataaagtgagctgccgcgactgcggcaacaaccacaaagagacctgtcccaagggtattaagagcctggacgcaagcctgaacttcaagacaaatgggacagttttcccctatacagttatggtgggtttcggcagtaatataaaatacggaaaagagcagcataataagaaccgacagggtcataagcccggcaagcagttttttgttttttgccatgtctcttcctccttttttaatcgcggatcgtatcagatacagtctttgcagataccgtaaagcacggatttctcttttctgatctggaatccatccgtttttaaaatgtcttccagcatcctgtcggcaataccggcattcatatgaaatgtctttccgcattttatgcagcttaaatgaatacgattacggcaatcttccgaatgaatatactggtaatagattccctgtttccatctttggtgaagcggttgatcagcccctgttcctgaaggaaagtgaggttacggtacaccgcacttaaactgactggagaaccggaaaggctgtttgtgatctgttttgcagaaaactgcttatcaggattttcctgtaaaaaagcaaagagctgttttctttgttctgtcatataattagccaaagggattcacttcctgaatttacgatttgtgtgcaaataagtgtactgctgaaaataaaaattgtcaatataatttgcgaatgcttcgcaaattgccccaaggtgaccataaagtaaaaaggtgaagtttttaccgcaaatttcctgtttatatttacataatatggcagcctgtgttaaaataagcgtaatatttatcaaggagagcggcaatgaaggacttgtacaggcgaaagaaggcatttgtaaatattggtttaattgctataaatgtcatctatttcctatatctggagatgacaggctccacggagaatacccggtttatggtggcacatggagcgatgtatgctccgcttgtattggagggaggagagtattaccggctgctcacttctgtttttatgcattttggaattaaccacattatgaataacatgctcattttgttcattctgggtgataacctggaaagggcacttggccatttcaaatacctgcttttctatctgctttgcggggtgggcgctaatgtgctgtccatgatcgtgaatatgggagaataccggagtgtagtctcggcaggggcttcaggcgctatttttggcgtgatcggaggccttttatatgcggtactcgtcaatcgcggccggctggaggacttaagtgcccgacagctggttattatgattgtttgttccctgtattttggttttaccagcacaggtgtagataatgctgcccatattgggggctgctttttggcattgttatggggatccttatgtaccgtaagccgagaaagtgccgcgatatggaaatatgggaataatccatttggaaggaggtgagaaagtgagggaagataattgcattttctgcaaaattgcaaatggcgacataccttctgaaaccatatacgaggatgatacctttcgcgccatactggatttaggaccggcttctaagggacatgccctgattcttccaaaacagcattacagcgatatttgccggctggatgaggaaacagcaaaaaaggtccttccattagctgcaaaaatagggaacgccatgaaacagtcattaggctgtgccggatttaatgttgtgcagaataatgggaaagaagcaggccagacggtttttcattttcacgtgcatttgattcctcgttatgagggaggccctgttatggtttcatggatgccgggcgaggcgagtccggaggaattaacacagacaggagctgctatacggagcgccctgcaatcagagggacataataaatgagcatacatgaagatgaaaatttgctgctgcagtccatatatggagagtatcaggggctgctccgcagaatagccaaaacactcaatgtaccggatatggaattggacgatgtggtgcaggaaacttttattgcatattttgagaattattcattatcatggacagatacgcgaaagaaaggcatgctgattaagattttaaagcgtaaatccattgactgcctccgtaaaaacggccattatgaaaaggtgagtctggatgaggaagacgcggtcaatgaggtggcgatgcttaccagatatgtggttactgatcccctggatgtaatccttggagaggaagctcttttaaagataaccagggagatttccggtatgagagaagagtggaaggaaatggctgttctttattttctggaacaacttaccattccggaaatctgtgaaattctgaaaattccgggaacggtttgccgttcccggatatatcgtacaagggtttgcttaaaaaagatacttggtcccaactttgatgtgtgaaggctatttctttacaagggattcgatcatatcaatgatggtatcaactgcattgtataattcgctttgctccatttttgaaataaaggtatgccggttggaataggtttcggtgatggcctgtaagagggaatctccggttaagttttcttcttccagaaggaagctgaagccttgctttgcaaaggatctggcatttaagatctgatcgcctctgctggcggcagcggaaaggggaatcaggatatttggctttctaagagcgagaatttcgcagatggaattggctccggctcttgatatcataaggtcagcagctgcaaaaaggtgttttaaaggggcgtctacatattcatactgtacatatccttccgttccggtcaggctttcatccagattgccttttccgcagatatgtatcacctggtaatttttaagcagtttcgggagaatgccccttagggtggtattgaccgttacagaaccaagacttccgccgatgatcaggatcacaggccggtttgcagataaccgtgcatattttaatcctgtcagccgatccccttctaaaagttcttttcgtatgggcgagcctgtgagtatggccttatcttttggaagataaggaagggtttccggaaaattgcagcatacttttactgcggccgggatgcacagcttattggcaagtcccggtgtcatgtctgattcatgtatgatcacaggcaccttgcagtgctttgctgcaaacactacaggaacggccacaaagcctccttttgagaaaaccacatccggcttgtaattttttatcagcttcaaagcttcccaatatccctttaatacccggaagggatctgagaagttttttaaatcaaaataccggcggaatttaccggaagaaatgccatcataggggatgccagctctcttgatgagctgaccttcgattccctggtgtgatcctatatagtgaatatcgtaatttcgctcttttaaagagggaatcagagccaggttcggggtaacatggccggctgtaccgccgccggttaaaatgatttttttcataaagcgttgcctcccaaattcgatatactattatagtaaacgttagcgataaaaagtcaaccccaaagcgtgtgggaactaaaggataacttgtatttaagaggtgtatacgtggagaaggagagaaaccatggaaaaaaatgttccattttaaaacggataaaatattatgtattatctcaggaaagaatagaagcccatctccttgattatatgcaggagcatccggaattaacacctgagcccccatcccctcctcccggtgaatttcagaagatcatggcagaacttaacaggcggggggcagagacggtggtaagaaagcagctaaaggtattgtattacggccacagatttgtaaattccctgcaaaagcctctgcttatcgtgatggtggtcctgatcgtcctggcggcctctgcaatcggggcttctgcaaagaaggcgagcaattaccggatgagagagcaaaataccggtgagagcaaaagcgaagtgcttaaagccaataagatgtcaaatgcatatgaagaaatgaaagaacatccaaggatcggactgctgatgattaacgatatagcctatgaccaggaccgatgaaattttaagagcagaatgcccggcggaaatgagatgatccaaaatcttaaatcctgccgggtattttcaaagatcaatccaggaaagggctgtccacgagaaagacgtttaccggggcagtgctgcttcccattccttttccttaaagccaaccagaacaaagtcctctccaataattaacggacgcttgaccagcattccatcggtagccagaaggccgatctgctctttttcgctcatgtccggcaaaaggttctttaaattcttttccttgtaaatgatcccgctggtattgaagaaccgttttaaaggaaggccgctttttttgatccattctgcaagctcctctgaggtcgggttttcttctttaatatttctgggctcatatgatattccatgggcatccaaccatttttttgcatttttgcaggtactgcagggagggtattgtaaaaataaaatgctcatatctttagatctcctttcggctaacagcgcaagtccgcactgctcattgctttcgtggatagtttacctcaaaacgccttgaatgaaaaggtaagaattggaataaactataacaattatgaaattttaggtgaaaagatgaagtttctattgtttttgtctgaggcggcggtgccgcttatcattttttacatggtaggttttgggatcttgtccaagcgtccggtctttgatgatttcatagatggggcaaaagaagggatgaaaacggtggcagggatcatgcccacactgatcgggcttatgactgccgtaggggtgctccgggcgtcgggctttctggactttcttgctaagtgcttaacaaagccggcttccttcctttgtcttccagcgcctgtggtaccggtgattctggtgcgtctggtgtcaaactcagcggcaacagggcttgtgctggatatctttaaaagatatgggactgactcctatatcggcatgctgacttctgtgattatgagctgtacggaaaccgtgttttattgcctgagcatctattttggaaccgtaaagatcaaaaaaaccaggtataccctgggcggcgcattggcagctacggcggccggagttgctgccagcgttatattatcccgttttctggtataaaaggtatttttttgtttcgattttaagaatttcataagaattcaggtggttgtcttgggatacataatcatgtataattacgaagaagcttttattgtcatatgtgaaggggataaacgtggatacttacgggactcttaacgaagttttggtaagactgtttcgggatattatggatatagaacaacaggctatcattacccaggaatttaacaatattacgaataatgatatgcatgtgattgaggccatcggcattggagcgcctaaaaatatgtcgtccatagccagggaactgtccgttactgtgggaaccctgactattgccatgaacagtcttgtgaaaaaagggtatgtgacccgtcagagaggaaaagaggaccggcgagttgtatatatctctctttcagaaaaagggaaagaagcctatgagcaccatgctgaatttcatcaggagatgatcgccagcgttgtttcgggcctaagtgagaatgaggtagaagttttgatcaaagctctgaccaagctgaatcagtggtttcggagtctttaacagaatttaaggaggcaatatgcaattatgaaaaaattcatcgtgtttttaatgagcgcaatgataatgatgtccctggcggcgtgtacaccaacacagcctaagatggagacgactgcgcctgatccccaggtgatggcttcaacaggcggtgcaagcgataaggttcctgatcccaacgcagagcctatggaggtcatttccgtatatagccagaatgatgacggtaccggtttgaatcaggccatggatgcagtatcggagctgacggcagaggccatggtggacaaactgatcgaatacggcgtattagaggaaggaacaacagttctgaaatttgataaaaaggatggaactgccacccttgatttatccaaggtgccggacaagggttcagacgggatatactcatgttgacagccattggcaatacttttatcgagaatttcgagctggataatttaaagctgcttgttaatggaaataattattccggagaacagatcaagcagggagataatgattatctggaatatgttaagaattataagaagatgaaataagagcaaaaaatagggcagaagcggtacatcaccgcttctgccctttgccttatttggttcttaattcttttgccagccagttgcggaatgcaggctggatgacggaaaatggggcaggcccgatatcaagtaaaaagccatggaaatcctttaagttaaaatcatcctttaagatcttttttgctgtgttcagcatttccacaatttctaagtatcctacatagtattccatgtaattggtggggttttcgatcaggctgttgtaaatggaatccacaatatccgtgttttccacgttgtaaaaggtgccaaggtacttggctgtctgctccttatcccagccctcataattgatgcagatatccaaatatgcgtagatgcccagggtaacagcggtattatgggccaaaagcttcccaagctccgggtccagcccgttatccagagtgtaggagtaaaattccacataagtggcccagccctccgaatagctggggaaggagaggatgcttcttaaatcgctgggattcctgcttaagaaatagacgttttgatataaatgtcctgggtagccttcgtgtgccagggtggtgaaaaggtcgtcattttgaaaacgcgggttgccgttgatgtaaatgacgttatcctcataacggtccagaggaggaactaaataaaaggcagggcttaaggaagcttccagggagctgggaacgtattttaccgtatagctgcagggcggaagctctggaaaatccttggctataagggtctttaaagattccaggatatcctccggcttggtatagcggaaggaataattatcaagggagtccagtacctggggatgttcctttgtgatctgtccgatggcctgtatatcagagttcagctgtttttcgatggcctttgtcagacttcggatggtaccgtaggaggtcccggtattggaattgaccagatattcaaaatactcttttccctttggataccagcttaagcccttgtcattggtcccggtccccataagggcagtgatgccgtttacaaggtttttataggcaggtatgaagtgctctcccaggatttttaaattcttctccttataagctgccttttcttccggtgtcagatccgtaagggcatccaccctggtgttgaacgtctccgcaagaaagctgtggtcaggctggatcaaataagcctcacaggactttaatacgtgatcggcagcagagtcggacataaaaagccctgcctctgattttttcttttcaaactccatgatctggccgtaataatcatcaatggtggaaagcagcgcaaggtagtgatccacatcatcacgggtataaaaggcatactcggaaaacaggataggaagctgcgcctgaatcccaatggtgctggttaaaggctgggcgtaaagctccagaccgtcagagcttaattctgtgtctatgtaggagcggaggatctgccaggtaagccgctgttcatcggacagctggcgctggttgaatccgtccagcttcttctttaactccaaaagctcttgtgttccccctttcattttttccagggaaaaatccccaagggtcagaggaacggtgtcaagtccccgggatgccggattggcaatgctgaagtgaaagctgatcccggaattgctgatttcctcacgaaacaggtcgtttgtaaattgatcaaacttgttttgagtggacagatccttggcatggtattgttcatactcggcccatgaaggcgatgcaggcggtcttttgattggtgagcaggcacaaagcagggaaattgccagaataatggaaagaaaacggctgccctgtttcaaaacgatgtttttcatatatgagtcctccgtgattcgctagtattatttatatgatgagattaaaaaagtcatgacaaaagccctgaagtacaggcttacccgcttgacaaactttacggaaaccattaaactagggatactgacaatctatttatatgaaaatgctgagaaaagaagagtaagaaatccacctcatgtgcagagacttccggaagctgaaaaggaagcttgagcgtatttcccaacatggccttggagcagcggaattgaattggcagattcatgcctttaaattccgacggttacacccgttatcgtgtcagactgttattaagtaaccataaaatcccggaaggattttaggaagctgacgcagccggtaaggtccgtactgtaaggtgcggataaattaaagtggtaacacgggacagttccccgtctttaaatttccgagaggatattttaaggcgggtttttctttgcagggaaaacactgccttttatcgaagcttacattgcaagttacgataagccatattataaacaggaggaaacaagaatgtgtaaaaattctaacaaaaaatcatactacatcaccacagccattgcctatgcatcaggaaaaccccatatcggcaatacctatgaggcggttttagccgatgccattgcccgctataagagggcggaaggctatgacgtattttttcagacaggcactgatgagcacggccagaagatcgaggaaaaagcagaggcagcagggatcactccaaaggagttcgtagacagggcagcagacgaaatcagaaagatctgggatctgatgaatacctcttatgataaattcattcgaaccacagacaaagaccacgaggagcaggttcagaagatctttaaaaagctttatgaacaggacgacatatataaaggatattatgaaggtctatattgcactccctgtgaatcctttttcacagaatcccagcttgtagacggcaaatgtcctgattgcgggcgggaagtaaagcctgcaaaagaagaggcatattttttccgtatgagcaagtatgcggaccgtttgataaagcatatcaatgaaaacccggattttatccagcctgtatccagaaaaaacgagatgatgaacaatttccttcttcctgggcttcaggacctttgcgtatccaggactacgtttaagtggggaattccggtatcctttgacccaaagcacgttacctatgtctggcttgatgcgcttaccaactatattaccggcatcggctacaactgtgacggcaaaagcagtgagcagtttgaaaaactctggcctgcagaccttcacctcatcggaaaggacatcatccgcttccataccatttactggcctattttcctgatggcccttgatgttcccctgccaaagcaggtatttggccatccatggctgctgcagggcgacggcaagatgagcaaatccaagggaaatgtcctctatgcggacactctggtggatttcttcggcgtggatgcggtccgctatttcgtccttcatgaaatgccttttgacaatgacggagtcatttcctgggagcttatggtagagcgcatgaactctgaccttgccaacatcctgggcaatctggtgaaccgaaccatttccatgtccaacaagtattttgagggcattgtaaatgacgggaaggcagctgaggctattgatgaggatttaaaggcagtggtgctggaagaggtaaaaaaagtccaggaaaaaatggaaaagctccgggttgccgatgccatgacttctatatttaatattttcagaagaagcaacaaatatattgatgaaacaactccatggacccttgctaaggatgaagcttccaaggggcgcctggaaaccgtcctttataatctgacggaagccattgccataggagcctctcttcttgattcctttatgccggaaacctctaaaaagattctcggccagcttaacacttcaaagagagagctgtcccagatgagtgaatttggcctctatccctccggaaacaaggtgaccgacaagccggagatcctgtttgcccgcatggatatcaaggaagtgatggaaaaggtggaagccatgtacccatcaaaggcggaggaatccaatgagcctgacaaggaagacggatctgcagtcatagatattgaagcaaaggctgagatcgaatacgatgattttgccaggctgcagttccaggtaggtgagatcatcgcctgtgaggtcgttccgaagtcaaagaagcttctgtgttcccaggtgaggatcggaagccaggtaaaacagattgtcagcggaatcaaggcccactacacaccggaagaaatggttggcaaaaaggtgatggttgtggtaaacttaaaaccagcaaaactggctggagtcatgtctgaaggcatgcttctctgtgcggaggatgcagagggcaatctatcccttatggttccggaaaaacctatgccggcaggagcagaaatctgctgataaaagggaatgtcataccccgtaggaagctacggggtatttgacttgatggctggtcgtgttagggaggaggaatccatggagaagtcaataagtgcccgtacaaaaggaataacaggaaatactttaaagatgatcgccattgttaccatgctcattgatcacattggggtggctatcattgaaaacggcattttaaagtatcagagcatcaatccgtcctatgaggtttacggtatggcggaaagcatgtggggcatcatcaacctggcgctccgcaccgttggaagggtcgcatttcctatcttttgttttctgctggtagaaggattcttccataccagggatattaagaagtatggggccaggctttttgtgtttgcccttatttccgaaatcccctttgatttagctctctttgacaagtggttctacccaggatatcaaaatgtatatgttaccctgtttatcgggctctgtgtcctttattggtatgaaaaggtctcaggggaccccgtcaaacggactctggtgtttctagccggctgcggtgcgtctgtagtcttaaaatgtgattatagtattataggaattgccatgatcctgcttttttatatttattatcataataaaaaactgcagaccatatttgcagggatcctggctgccgttgaaagtcttggctgctttggagccgccgtcctggctttcattccaatccgcatgtacaacggagccagaggaacagggaatttaaaatattttttttactggttttatcccgctcacttaatattgctctatatcctgcgtttgctcatcataaagtaagaaaggcatccaaatgaccggaaggggcctggttttttaaaggagatttttatgatttttgatacacacgcccattatgatgatgaggcatttgatgaagacagggaggaactgctggcaagcctttacgcccatggaattgaggctgttaccaatataggagccagcatggaatcctccggacatacactggaactggcagagaaatatccatatatatatggagccatcggcgttcatcccaatgagaccggagaaatgaatgaagaggacttaatctggctgaaggaacagtctgccaataaaaaaattgtggcaatcggtgagatcggccttgattattattgggacgagccggatcatgagactcagaaaaaatggtttatccgccagctcggtctggcaaaagaggtaaagcttcctgttgtcattcacagccgggatgcggcaaaggacactctggatattatgaaggcagagggaggaaaggacattggcggagtgatccactgcttttcttatggaaaggagatcgccagggaatacttgaatatggggtattatctggggatcggaggcgttctcacctttaagaatgccagaaagcttaaagaggtggtggagtacatgcccatggaacagctggtcctggaaacagactgcccttatctggcccccgctcccaacagaggaaagcggaattcttccctttatcttccctatgtggtgcaggagatcagtatcatcaaggggatcccagaggaaacggttattgaaatcaccaatcagaatgccaaaaagctatacagaataaaggaacagctataaaggaaaacggaggacaggcatggcgaaactgggaaatccccaaaaaactattgagatcattcaaaagtatgaattcgcattccagaagaaattcggacagaattttttaatagacacccatgtattggataagatcatagctgcagcaggcgtgacaaaggatgactgcgtcctggaaatcgggccgggaatcggcaccatgacccagtatctggctgaaagcgccagacatgtagtggcagtggagattgattccaacttaatccccattctcaaagagaccctgggggaatatgaaaatgtgacggttattcatgatgatatccttaaggttgacatcaatcagataacagaacagtataacagcggacgccccattaaggtggtggcaaatctgccgtattatatcacgacccccatcatcatgggcctgtttgaaaacaaggttcctattgacaatatcacggtcatggtccaaaaagaagtggcggaccgcatgcaggtagggccgggctccaaggattacggcgccctttccctggcagtccagtattatgcagagccttatatagtggcaaatgttccgcctaactgcttcatgccccgtcccagcgtagggtctgcggtcatccgcctgacccgccacaaggaaccgcccgtaaaggcagaggatccagggcttatgttccggctgatccgggcttcctttaatcagagaagaaaaacccttcaaaacggcttaaataattctccggaagtcccctatacaaaggaacaaatcgccgaagcgattgaaagcctgggacttggtccttcggtgcggggagaggcattgaccctggagcagtttgcttccttaagcaactattttacaggaatgaaacagtaatagaacaggaggccctatgtcggattcgctgatcacaaaacgcgcaatagcggaagccttaaaacaggtatgcagggaaaagccctttgataagatatccatatccaacatcacgtccgtatgggggttaaaccggcagactttttattaccattttcaggataaatatgagcttttaagctggatctattataatgagaactttgcaaaaatagcagatgacatcacccttgaaaactgggatcagaagatttttgaactgcttcaaaatatggaggaagaaagaaccttttatatgaataccataaaagaacaggagcatacctttgaaagttatttgtttgagatggcaaaggccctgttttccgaagcgattttaaagctggatgaaaagaagaagctcacaaaagaggaacgggattttgatgcggaattttttgcatatggcatctgcgggatcatcgttgactgggcagaaaagggaatgaaaacggagccgcggctggtggcggaacgtttaaaaagcctggccagggctgcggagcgggccgcttacctcaggagccaggcagagttttaagaaagcttatgcatgataatatccagacattcttcccaggaacagcttttaataagagaaaccagatcagaataagaaaaaagctctgcggatatgggattgaatttttgcagcagctcttctaggttacgggcggtccgctccggtgatttctgtccgtttcttaactgatggagtagcgctgttttcaggacggactcccggatatgtttgtgtatgatggctgacataaaaagccctcctttttaactatattcattttaaaagaagataagcaaaaaacccatagacaaaactgaaaaattgtctggttttccgacatcattgacctgatgtcgtttttttatacaactgaaaaaccatgtatggtgacggataaaatgaagtatgataatataagcgtatcaagcgaatcagttatcacaattcatagaatggagcgttgcatatgagaggaaaaaataatttcggaaaagtgcttgcatggggagctgcggcaactgcggcaggagttgccgcaaaaaaggcctatgattattcaaaaaagcaaatggatttaaagaaggaagaaaccatgaggccagagggaagcggccagacctcaggaaaagcatattttgtcggcggcggtctgggaagcatggcaggagctgcttatctcatacgtgactgcaacatgccgggagagcagatcacgatttttgaagggatgcacatcctgggaggaagcaatgacggcatcggtacccctgaaaaaggttttgtatgccgcggcggacgtatgctgaatgaagaaacttacgaaaatttctgggaactgtttggttccattccttctttaaataaccctgccagaagcgtgaccgaagagattttaagctttgaccatgctcatccgacccatgcaaaggccaggctggtggacaaagatggaaccatccttgacgtaaagagcatgggatttacccagcaggaacgcatggccctgttaaagcttatgaacacgccggaagaaaaactggatgatatgaccattgaagaatggtttgcagacatgcctcatttctttaccacgaatttctggtatatgtggcagaccacctttgcgttccagaaatggagcagcctttttgaattccgccgctacatgcgccggatgatcctggagttttcaaggatcgagactttggcaggagtaacaagaactcctttaaaccagtatgacagtgtgatccgtcctttggaaaactatttaagaaagcagggagttgtctttgcagaaaactgtgttgttactgatatagattttgccgatggagacggaatcacggcaaaggtgcttcacttaaaggataatggaatagaaagaaccattgagcttcaggacggggatatctgtattatgaccaatgcctgcatgactgacagcgcaaccttaggagaccttcatactcctgctccggagcctgttttaaggccaatatcaggggaattgtggagcaaggtatccgcaaaaaagaccggtcttggaaatccctaccccttctttggagatgttcatgaaaccaactgggagagctttaccgtaacaagccggggaaataagctccttaagctgatcgagaactattccggcaatgtgcccggaagcggagcgctcatgacctttaaggactccagctggctgatgagcattgttgtggctgcccagcctcatttcatcaatcagccaatggatcagaccatattctggggatacgggctttatacggaccgtgaaggggattatgtgaaaaagcctatgaaggactgcacaggagaagagatgctcatcgagcttcttcaccatcttcacatggaaaaccgtaaggatgagatcctggcagacgtggtcaatgtcattccctgcatgatgccttacgttgatgcccagttccagccacgtaagatgacagaccgcccaaaggtggttccggccggctccaccaacttcgctttggtaagccagtttgtggagattccggaagatatggtatttaccgaggaatactcagtccgggcagccaggatcgctgtttacaccctcatgggagtgaataagaagatttgtccggtcactccttacgtgaaggatcctaaggttttaatgaaagcagttcagacctcataccgctgataaaagacataaatgtcctcttgggccagacatttccctatccggaaatgcctggccctttactgctttatcatggtaacactgcgcagaataaggagagtgtaaaaattttcctcgttgcaagaaccctctttctgtggtatgctagagcttgcgttgtctgtgatagacggacgcaaaaataaaaaagatatggaggaaaagatatgaagaagatggcgcttgtattagcggcagtccttgcttcagggatgatcctgacagcatgcggcggttccggcaagtccggtacaacaggcggcgaaacacaaaaaacagaagcggcaggaaataccacagcaggaggtcttgacctgtcagtacagatcgggcctgacccggaaaccattgatccggccttaaacaccacggcggatgctgccaatatgatccttcacgcatttgagacacttctgacctttgatcaggataataacattattcccggacaggcagaatcctatgatgtgagtgatgacggacttacttataccttccatttacgggatggcttaaaatggagcgatggctctgaccttactgcagaagactttgtatattcctggaaacatctggcagatcctgccacggcagctccttatgcagcagacatgctttccatggtaaaaggatatgaagaaacagcggcaggaaacaccgatgccctggctgtgtctgcacctgatgcgaaaacctttgtagtggagctggcgtctccctgcgtttattttgataaaattgttactcatgcaaccatggttcccgtgaaaaaggatgtggttgaggcaaagggcgaccagtggtccttaactcctgatacttatatatccaacggacctttaaagatgattgaatgggtaccaggctcccacatcacctttgctaagaatgaaaattactgggatgcagaaagtgtaaccttaaataccttaaaatttgtccttatggaagatgccaatgctgcatacagcgcataccgtacaggagaggttatgatgatcaaggatattcctactgatgagatcccaagtcttcagggaacaccggattatcatctggatcctcgtatggccacttcttatacgattttcaacgtaaaaaaggcaccctttgacaatgccctggttcgccgtgcattaagccttgcagttgaccgtgattatattgccaataccgtaatggccggaaccgttttaccggcgacaaactttgtaggccctggcatttctgatgtggaaccaggttcttcctttgaagaagtcaccagaaagaacaacggcggcgattactttaatgtgagcaactatgaggaagaccttaaaaaggccaaagaacttctggcagaagcaggctatccaaacggagaaggtttccctgtgatcgagtacatgaccaatgaagccggttacaataagccggttgccgagtatttacagagcgcatggaacgaactgggcgtgagaatggatattaaaatcgttgaatggtctacctttgcaccaacccgccgggccggtgatttccagattgcccgcggaggctgggtatatgactatgacgatccttccaacatgctgaacttattcacctcagaaagcggaaacaacgatggaaagtattctaatcctgaggtggacagcttattaagccaggcccgtgatacggctgataagaccgagcattatgagaagcttcatgaagcagaaaagatgattatggaagacgcagcgatttcccctcttgtatattccagcgatttctatctgcagaagcctgaattaaagggcacatggcactcttcatacggttactggttctttacacatgccaccatggaatagtggctgagaccagagaacggttatgaaatagcttaaaaacaaataaaaaccgcatcttgactgagctgtaaaagctgtttcaagacgcggttttttacattaataaattccagtgaaagcctgctgatgttctaaatccctgctctcgcctctcctgttcatcccatggaatcgttatagcaggcacgggcaccgccgatatatttcggcctggtacgggcggtgaccacatgggcggagccgatgtagcgggttttaatgcggaccggaacagccacggcctttaagtgcattccgatcagggtgtccccgatatcaatgccggcatgtgctttaatggactccaccgccaccggacattgtaaagtctggtaagccgcagtggcaaaggagccgccggcttttagctggggcatcacattgaccggctcatagccatagagcgttgccgcctctttttccaggatcaaagcccggtttaaatgttcgcagcactgtgcggcaacgtatattccctgggcctgaaaaacctcgtagatggcggaaaatactgtctgcccgatttccgcgctggaatgggaaccgattctgtgatcggagatctcactggaggagcagccgatgacgactaaatctttctcatttaaatgtgcagcttccaacagttcttttgcggccattgcggcctgtgtcctgatttcatccagcatgatccggcctcctcttcatgaatatggtttctttctacaatgctgcccggatagcagcagccatttcctcgtattccttatccgttaaatataccttgtccgggttcatggcaaaggtacttccccattcatcccctccgttgtatttcggaacgatgtgcatatgaaggtggcagcctgtatcgccgtaagcgccgtaatttaccttatccgggttaaacactttatgaacagccctggaaaccctggcaacatcggcaaaaaaggcatttctttcctcagcctcaatgtccaccagttcgctgacgtgatctttataagccaggatgactctgcctttcttactctgctctttaaataaatataaaaatcctgtttccatttcgcatatgggatagccgaatttggcaacaagttctcccttcatacagtatgcgcaatttggatctttcataatcatgtaccttcctttgcttcttcttcaagagattaagatctgcttttaatgtgagcggctacttttgcatcttcctttttaatgtgggtgatcagccagccggcaatggcgctgttgacttcacctacaaggattatggacgggccatctttgtcaagcttagaacagattccggccaccacctttttgaagtcttcgtgataacgtttgtggtttacataatccggatactgatactgaagctgaagcatttcctcattgccgaaatgctttgcagtatagtcctgcaaaaatttggtcgtattagccagttccgcacggcccttgcctgtagcgcaggcggcgagcaggttattgaccgcatcgatcagctggcgatgctcggaatcaattaattgatttccggtttccaaatcttttgtaaatgtatatgccatatttaccgtctccttatcttacgttttacactcattctacaccattttctgaaaaaatccaaccgttaattttcccgccggctaaagggaaattccggctttatccccttaaaaagtgccttctgaaaaagaaaaaaatgcccggtgcaggtagcagccgggcaaaagcaatcatattatttgacagtaaaaaaaataaaagactgtgcttagaagttttccattctggtaagtgctgcttcgtctgcaacgatgataacatccggatgaagctgtaaaatggatgccggaacacgggaggtgaccggaccgcagattacatcataaagaatgtccgctttgtcggctccgctgatgatcagcaggattttcctggctctcatgatggtgccgatacccatggtatatgcctggcggggaacctcgtcaatggatgcgaagaaacgcttgttggcttcgatggtgctttcctgaagatccacaatgtgggtatcctttgggaatatatcggaaggctcgttaaaaccgatgtgaccgttgtgtccgagacctaaaagctgtaaatcaatgccgcccaggcctttgatcacttcttcatagcgggcagcctctttattggcatctgtttccgttccattgggaatattggtgtttgcttcgtcaatgttcacatggcggaaaagattttcacgcataaaataataatagctctgatcattttccctggtaagccctttgtattcatccagatttgcggtctttacctgggagaagtctaaatctcctttattataccactccaccagctgcttataggtgccgacaggcgaggaaccggtagccagtcccaaaacacagttcggtttcataatgatctgggcagaaataatattagccgccttacggctcatatcattgtagtcttttgcgcgataaagcttcatttctttatccctccatacgttcgaaaaaaattttattatattcttttcactaggataacatttttgtgtcatagatgcaatggcattttgcataaaataattataaaggagtgatggcatgcctaattatcgaagactaatctcatatatttatgcctatgaaggcgcagtcaaaggaaaaaacatcggatttgccaagatagaaacgagaggggtccagtgcaagattacggtcagtgtcaaaaggatatatgtgggcggcaatgatattggagtgtacttattagccgcagaccaggaaatattcctgggcaatatttttatacgcggcggttccggcgaattcaggactgtggtatcggcaagcgatatagaacactccggaattaatatggaacagtgctttggactgaccatccatgatgtaaaaaatacatggcgttcctacacgaccatttgggaagatgccgttgcccatgcggcggaagtcgatttagagagtacggccaaaatggtttccgtgaaggaacaggccgttatttcagaagaacagataaaacgggcggtacgtgagatcgaggaagaatttccgctggagcctgataaatcccgggagactgcccagacagaagtttcccatgaggaaaaaacaatggaggcttcttccaatgaccgggaggaagaggaagctgcaccggtcccagaaaaacaggaactgccggaagaggaagatttgcagacagagaatctggaggcggaaagtcagagtccggatgacgaagctgcggattctgccgtgccggctggggaagaattggtaaatgcggaatcagaggatgtggaacaggaacaagtcatttcggatgatgcagaggtggctgaagaagagcttcagcatacggaggaagcagaggcgcagccagaagaagccggggagccggatacagagccggatgcatccacatttatggaggccttcgaatcagcggaagcagccacacccgcggaagcaactaaaccaataaaaacggccataccagcggaagcatttataccagcggaagcattcatgccagcggagtcagccatgccagcggacgcgttcacgtcagcggaagcatacacgccggcaggaacagccataccggcggaagcattcataccggctagagaagccataccagcggaagcgtttatgtcagcggaagcatacacgccggcaaaagcagcgataccggcggaagcattcatacctgctagagaagccataccagcggaagcgtttatgtcagcggaagcatacatgccggcaaaagcagcgataccggcggaagcattcatacctgcagaagcattcatacctgcagaagcatttataccggcggaaacatccatgccaacggacgcatttacatcaacagaagcatccacatcaatggatgcacagcagcaggctgactggcccgaagcagaggaaccaatgccggaagctatgcaggatatagtacaatctgtggaagaatcgggtcccggagagtgggaaaatgccggacaggaagacattcagggcgaaatgcaggaagaggaagaagtgcagggagccagggaagcagtggatgtccaggagaaagaaccggtaatcagtgaaccatatccctgcagtgacgaggatatggctggggatacgatcttataccgggcagatgctgtgataagtgaagacaggagcaatccggaggtccggccagagctgggaaatccggatgaattagagcgcctgcgccaaaatgaagaccaggacgaagctccccatgatttaatctgggagaagctgaaacgagaacatacaaggattctggcatttgattatgaagatggctgcgaaattctcaccattaaaccccaggatatcggtatccttccaagagacacctgggtctatggaaataacagctttcttctgcatggatactataattaccgctacttaatcctggcaaagctgttaaacccaagtggaatgccccgttaccttctggggatacccggacattattacagcaatgagcgatacatggcttctatgtttggttttccaaatttcgtgctgtccaaagatcagccgatggaagacggcagatttggattctggtataccgatataaaattagggggctgatttaagcccccctatcggcatgtccccattaatcatcaacgccccgaagcatggcgttgggaatcaggggctttaagacatttataaagctgtccagttcttccctggaaaaagactggaagcctgggcataaaacctggtccgaatccacataattctgcagataataatggggacagcctgccagccaatctccgatatccataaaatcctccaggctgtggattccttttaccgctgtggtacggaattcaaaaggaaggattcccccaagtaaaaaggcggcgctttcctcaatattttttatttttatgttccatacgcctgcagccctggagtaattctccctgccggctttaatgtccattgccacatagtccaggagttcgtttaaaaccagcctttttaaaacctccggccggtaaccgttggtatccagcttgatgagataccccagttcccgtattttacggataaaggcctccaaatcctcagacagggtgggttctcccctgtgatgcagaccccttctaaaatcccttttcgtttccttaaaaagcttaaaatttcttcctcactgaattctgactttgcctcactgccgatcagctcactgttatggcagaaggggcagcggaaattgcagccgcccagaaagatcgtggcagccacatgaccgggaaagtccagaagcgttgttttttgaagaccgcacagtttcataccttcaccattcctttgtttcgtgatatactataccagtatatcacatgaaaaagcccggagtatatctttttgtgtcccaaaatatgttaagatacttttggggaattcctttttatctggaaagcactggaaagaagggctatccttatatgtcaggataatgtggcaggaaatataaaaagcaaagaggaacgagaatgaccattgatgaaaaatatatgcgtgcagcaatcagacaagctgaaaaggcgggcgccttaggcgaggttcccatcggctgtgtcattgttcatgaagataagatcattgccaggggatacaaccgccgtaccattgataaaaatgttttatcccatgcagaaataaatgccatccgcaaagcgtgcagaaaaataggggactggagacttgaaggctgcaccatgtatgtgaccctggaaccctgtcccatgtgtgcaggagccattgtccaggcaaggatacccaaagtcgtcatgggctgcatgaatgcaaaggcaggctgtgcaggatcggtgcttgatatgcttcacgaggaaggctttaaccatcaggtggaaacggaaacaggggttctgggagaagagtgctcccagatgatgaagcgttttttcaaagaactgagagaaaataacaagaagaaactggaaggcaaatcccccataactccttgacaacctgctcttttccatgtatactaaagtgcgattaaaacaaaacatgtcataaagtttccgtgcagccggggagatagcggtgccctgtacctgcaatccgctctagcaggggtgatgtctcacccagggccgtctattgcagggctgcccctgataagtggcgatgacgtttgggtcttacgcaacagatcttcatgaaccgtgtcagggcaggaatgcagcagcactaagtggaaccttctgtgtgccgtgagggtgcctggaccgagctaactgtcagggtaacgcctgtgatagcggttcaaagtgagacgcacggattaaatataaagaattttcagacgccggagagcaaaaaactgctttgcggtgtcttttgcaatctgcaattcccatttttaatattttcttacatttcttatgaaataaagttttcccttgccccgcattcccctttgtattataattataaaatgggtataatactacctatttcccaatgacaaatcgaatcaaaaagaggtgtgcttttatgataagaattggaatgcttacaagcggaggcgactgtcagagcctgaatgcaaccatgcgcggcgtggccaaggcactgtaccggttatgcggtgatattgagatcgttggatttgaggacggttacaaagggctgatttatgcgaactaccgtgtgatgaaaccggaagaattttccggaatcctgacaaagggcgggactattctcggtacctccagacagccatttaaacttatgcgtacacctgacgagaacggtcttgataaggtggaagcaatgaagcacacatatcgtaagatgaaactggaatgcctggtggttttaggaggcaatgggagccagaaaacagccaatctccttcgggaggaggggctgaatgtagtatcccttccaaagaccattgataatgatttgtggggaaccgacactacctttggttttcaaagcgccatcaatgtggcaaccaatgccattgactgcattcatacaacagcggcttcccatggacgagtctttattgtggaagtcatgggacacaaggtgggctggctcaccctgtatgcggggattgcaggcggggctgatatcatcctgcttccggagattccctatgatctggatatcgttgtggaagcattaaaaaccagaactaaaaacggcaaaagattttccattctcgccgtggcagaaggggcaatttccaaggaagatgcctgtctgacgaaaaaagaattaaaagaaaaaaagaagagcggagtggtttacccttctgtggcatatgaaatcggagctcagatcacggagcgcaccggacaggaagtacgggtcaccgtaccaggccatatgcagaggggcggcgacccatgtccttatgacagagtgctttccacccggcttggggcagaagcagcaaagctcataaataacaaagaatacggatatatggtagcggtggataacaatgatattgttaaagtccccttagccgatgtagccggaaaattaaaaaccgtcgatccgaaaagctctattgttgaggaagccaagatgataggcatcagcttcggcgacgaataaggagttaacaggcatgtcatatacggcattgtatcggaaatggcgtccgccttccttttcagatgtaaaaggccaggaccatatcgtacagacattgaaaaaccagatagtagccgggcgtatcggacatgcatatctgttttgcggaacaagaggaaccggtaagaccagtattgccaagatatttgcaaaagcggtcaactgtgaacacccggtggacggaagtccctgcggggaatgccagacctgtaagaatatcgcagccggtgcttctctcaatgtggtggaaatcgatgctgcgtcaaataacggcgtagaaaatatcagggagataagggatgaagtccagtatcctcccacagaaggcaagtaccgggtttatattatcgatgaggttcatatgctttccacaggagcatttaatgcactgttaaagactctggaggaacctccatcctatgtaatctttattctggcgactacggaagtccagaagatcccggtgacggtcctttcccggtgccagaggtatgactttaaacgcattacggtggagaccattgtagagcatttaaaagagctgacggctgcagaacatattcaggtggaagaccgggcccttacttatattgccaaggccgctgacggcgcattgcgtgatgccttaagccttttagaccagtgtattgcctttcattacggagagcttcttacctatgataatgttttggatgtgctgggagctgtggacatcaccgtgtttggaaccttgtttcaggcgatcgtggaaaaccggacaaaagactgcatcacctgtctggaagagctggtgatccagggccgggagttaggccagtttgtcattgattttatctggtatttaagaaaccttttaatattaaaatccgtggacaacggggaaaatcttctggatatgtcaacggagaatcaaaacctgttaaaagaggacagcaagcgtacggacaacgagacgcttctgcggtatatccggatattttcggatttgtccaatcagctccgctatgctttccagaaacgggtcctcatcgaggttgccctgatcaaactgacccgcccccagatggaacagaatttagattccatacttcagcggatcagcagtatagaaaagcagctggaaaacggcatcataggaactgcacctttgccagtcttaaacggggacgaaggaaaagacggcagcagtgcccctgtcccccaattaactcccgcagaaagggtggcccttcccaaaggccagttagaggatttaaatatgatccggggcgaatgggggaaaatcattcgggaactgggagggcctatccgggccagcttccgggatacagtggtagaacctgcaggagagagctgtctttgcgttgtctttaccgatcagagcaattacatgatcggaagcagggattcgaccgttgcagagattgaacggtatgtggaagaccattaccagaagtccataacctttaagacaaggctccggggcggaggggaacggtctgacaccatctatgtcagcgatgaggaattaaaaaccaatattttaatggatataacaatagaagactaaaaatcataaagatagcaggaggatacacaccatggcaaaacgtggcggttttccaggcgcaatgcctggcaatatgaataatttaatgaagcaggctcagaagatgcagcgtcagatggaagaaacaacaaaggcgctggaggaaaaggaatatacggctgcagcaggcggcggagctgtatcagtcactgtttcaggcaaaaagaagtgactgcggttaaattatcccaggaagtagtggatccggatgatattgagatgctggaagatctgatcatggcggctaccaatgaggcgttccgtcagatggaagaggacaacagctctgccatggctaagctcaccggcggtcttggcgggttaggcggaggctttccgttctgattatgaattactacagcagtcagataacaagattaattgaagagctgtccagacttcctggcattggcagtaaatccgcacagcgactggcgtttcatatcattaacatgccggaagaacaagtggcaggtcttgcctcatccattacagaagcaaaacgaaatgtacgctactgcaaggaatgctttaccctgacggatcaggagctgtgccccatctgccagagcgaaaaacgcaatcacaaggtgatcatggtagtggaagacaccagggacttagctgcttatgaaaaaacaggaaagttcgaaggcgtttatcacgtcctgcacggggctatctcccccatgctgggaatcggacctggcgacataaagctgaaggaactgatgcagagactgcagggagatgtggaagaggtgatcattgcaaccaattccagccttgagggggagacgacagccatgtatatcagcaagctgatcaagcccacaggaatcagagtcacccgtatagccagcggagttcccgttggaggagacttagagtacatagatgaggtgacattgttacgggccctggaaggccgggtggaactgtagctcatttgccttgttaggagatgcaggttgaaagaaacacatctttcagccttgaatattgtatcagttggatatgcacgcatatccgcttgattcattaggagacaaataatggataagtacgagtttaatataaaggttgaacagattaaaaaactggtcggcaaaaacgactatgagacggctatgaaaatagccgacacaatagactggaagagagtccgcaataccaatctgctatccatggttgccatggtttacgagaaaaatgaggattaccaggaggccaaggatatccttctccaggctttcgaacgcgctcccattgggaaacgtctgctttataagctggcagagctggcgatcaaagaaggaaatattgaagaggcggaagcctattataaggaatttggcgacctggcttctgacgatccaagacagcagcttcttcgctatatgattttaaaagcaaaaggagcccctgcccagcagctcatccattccctggaatcctacaccagtgtggaactggatgaaaaatggctgtatgagctggcagaactgtacagccttgcaggtatgcccgaccgctgtgtggaaacctgcgaccggatcatgctgatgtttggccttggaaaatatgtggacaaggccatggatttaaaaatacagtatgcaccgctcaccaactaccagatggatctggtggagaaccgggacaaatacgaggccaagctgcgggcggttgaacaggagtacagcgccggaaaaaggccaagcccggaaccggagcctgaagaagaatattatgaggaagaaccggagacggttatgacgtttggagagaaccctatggaggataatctggaagcaaggcttcaagatgccgcggttcaggaaaacctggccagggaaatgtccaggatctcctatgaagaacccataattcaggaagaatccaggctggaacacaccagagtgctggaggatatccggagagtgggcagtcccataaccccaatgccgggaaccagaggcatatacgcgtctgaaaatgaagactctcttttccatcacccggagcctgtttttgaggaagaggagccggaaggtcctggaatggaagaatcctccttggaagggcagtatgacagagaaatagaatatgaaaaacctgatgatgccggacaactgtccgcgatcacatccgaaggtttccaggaatccgatgaccagccggaggatgattatggttatgaggaaaacgattatgatcagccggatgaatcctattatgagaaggaagaagttacagagacgccttacgcatctttaaaccaggcctcggaagaggacgctccggcctggaatcaggacttccggaattttggcgatgaggaaagcctggagtttgaagatctgtatgaaggagaggaagacgagtcggaggaaacaccggttcagaatcatctcatgatagaagcgagaacccctgaaaaaggacttcaaatggctgtagaagccttaaaacagattcacaatgaaagcggagtaaagaatcctgtggcaaagatcaacggctccaaactgtcaaaacggggagtattggcttccgcagacaggctggccggaaaagaccttatcatcgaggaagccggagatctgacccgggaagccctgactgaattaaatgaattgatggaccgggataccagcggaatgatcgtggttctcattgataatcccaaacaaatggaaactctgcaccaggagcatccgttacttgcaagtaagtttgagtgcattggaaccggagaaggaactccggctttctgtataagcgaaccagtacgggaagaaagaccggtcaaagtccctgaagcgcccgtttacaaacctttcacccctgcccctaaggaagaagaactgagggaagaatcctacgaagcaaaccaggagtatcgttatgaatacgattcctggcaggagaacaattacggggaaaacagtgactatgaagaaggcgttcatgaagacgatgatttctatgaagaggatgaagaatttcgtccgtctgtccgggacgaggaaggtccagggtttcagggggaagaaatggacattgatgaattcgctcaatatgcctgccgttacgccaatgagattgattgcagcattaccggtaaaagcatgctggcactgtatgagagaattgagatcatggaagaagacggccttcctcttaacagggccaatgcggaaagcctgatcgaagaagcagctgaccgcgcagaaaagccgtcccttggaaaacggatcaaaggtttgttttctacgaaatatgataaagacggtcttcttgttttaaaagaggaacatttcatttattaaattggggtataaaacgtggatattaaactcattgcaattgatttagatggaactctgctggatagtaaaaagcatcttcccgatgccaaccgccaggcgcttatccaatgtgttcaaaaaggaatctggatcgttccatgcaccggcaggaccgtacatggtatacctgcggaaataaaagatatttccgggatccgttatgcgattaccaccaatggagcagtcatcgaggatatggaggaaaatgcggtcattgacactcagatgctgtcctgggagcacgctttggagcttttgaacctggtggattcctaccatgttatgtatgatccctacattgacaggcgcggaataacggagccccgcttctatgaacatctggcagagtatggtctgtcgtccgaattacaggaaatggtctaccagaccagggatgtccatcccaatatcatagaattcgtggaaaaaaaccataagcctgtggaaaagatcaatctgttcttcccaaacatggaagaacgtgccagacttagggccgagctggagaaacggggcgatgttctgatcacttcctccttacccaataatctggagatcaatgcattcggagcgacaaagggagaagccatcctaagactggcttcccatttgggatcagcagaaagcagaccatggccataggggatggagaaaacgacttttccatgatcaaaaaggcggggaccggagtggctatgaaaaatggaagcaaagagcttcgcggggcggctgattacataaccgataccaatgatgaaaatggggtggcatccgctattaaccgattgatattcggagcagaaggttgaaagaagaatgtctttcagccttgtatttatgaatcaactggatatgcatgcatatccagttgattcattaggaggcaaattatgacgaagttttatatggagaactggctgtctgttgtggcaggaatttatcttataggaatggttctttacggccatcacagaggatttatccggttggtcgtatcaatgctggcggtggtcttatccctgaccattgtccgggtttctctgcccactgtaacagggtttttaaaggaaaaaacaggccttcagcaaaccatttcagagaatatgaaaaaatccatgggtttggagctggaagaaaatccttccggagaagccttggaagcaccttctgtccagcgcacggtgatcgaaagccttaagctgccccaaagtgtcaagaacgctctcattgaaaacaacaacagcgaagtatatcagatgctgggagttcaggcgtttacagactatattggaggctatctggcagatatgatccttaattctgcaggatttgtccttctctttgcagcaatctatctgttttcaaatttagtcatgagatggctggatatcattgccaggcttcctattctgtcaggaatcaataagatcgcaggtgccctgttgggaggactggagggattggtatttctatggatcgcctgtttgctggtcaccgctttctcaggaacggagtggggccttgccttatcccggcagattgaagcgagtaaatggctgtcctttttatatggccataatttcctgaatctcatggttttaggggtattgcgaggcttcatataagatgggaattgtagctatcatatattcaattaaaacaagtctgcaagcaaaggtgagactgcctctgcttgcagattgttttatccaccacaaaatatggagaaattaaggaaaaatccttatatgtagtggtaatcaaattgctgaaaaaattgtttgaacaagtggcacaaattcccttgacaatatgatacggacatgttatattaaagacccggtgcgagacagaccgcagaggcaatcaattaaaacagattgaaaaaaataaaaaagttgttgacaaaaaatcggcaatatgatatagtaaatgagttgccgacgaagtaggtagcaacacaaaagcactttgaaaacagaagattgaacagtatgtaaaaccctgaaaattctaataaaacaagccattgtttgatggctttgaatgagaaaattcagaacgaatacaagtaattgtatacgaaccaaacaacaagtaaaacgggaaaaaaattagctagttagttgattttgaccccggattgaaccgaatggcaggtccaggcggtatgctcatgaagctttgcttcattcgctaccatttgcttcgcaaatgttcatagattagcaaaaaagtccttatgaaagcgagctttcaacagacttttctaccaatctctgaccgctttcaaagactatctgcttaaatttgagagttcgatcctggctcaggatgaacgctggcggcgtgcttaacacatgcaagtcgagcgaagcggtttaaatgaagttttcggatggaatttaaactgactgagcggcggacgggtgagtaacgcgtgggtaacctgcctcatacagggggataacagttggaaacgactgctaataccgcataagcacacagtgccgcatggtacggtgtgaaaaactccggtggtatgagatggacccgcgtctgattaggtagttggtgaggtaacggcccaccaagccgacgatcagtagccgacctgagagggtgaccggccacattgggactgagacacggcccaaactcctacgggaggcagcagtggggaatattggacaatgggggaaaccctgatccagcgacgccgcgtgagtgaagaagtgtttcggcatgtaaagctctatcagcagggaagaaaatgacggtacctgactaagaagccccggctaactacgtgccagcagccgcggtaatacgtagggggcaagcgttatccggatttactgggtgtaaagggagcgtagacggcgatgcaagtctggagtgaaagcccggggctcaaccccgggactgctttggaaactgtgttgctggagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgttggggagcaaagctcttcggtgccgccgctaacgcaataagtattccacctggggagtacgttcgcaagaatgaaactcaaaggaattgacggggacccgcacaagcggtggagcatgtggtttaattcgaagcaacgcgaagaaccttaccaagtcttgacatcggaatgaccggtccgtaacggggccttcccttcggggcattccagacaggtggtgcatggttgtcgtcagctcgtgtcgtgagatgttgggttaagtcccgcaacgagcgcaacccttatccttagtagccagcaagtcaagttgggcactctggggagactgccagggataacctggaggaaggtggggatgacgtcaaatcatcatgccccttatgatttgggctacacacgtgctacaatggcgtaaacaaagggaagcaaaggagtgatctggagcaaaccccaaaaataacgtctcagttcggattgtagtctgcaactcgactacatgaagctggaatcgctagtaatcgcggatcagaatgccgcggtgaatacgttcccgggtcttgtacacaccgcccgtcacaccatgggagttggtaacgcccgaagtcagtgacccaaccgcaaggagggagctgccgaaggcgggactgataactggggtgaagtcgtaacaaggtagccgtatcggaaggtgcggctggatcacctcctttctaaggaagaagaagtaagggttttatatactgttgagtctttggttttcaaaagaagtaaaaaagaataaaaggaaacactaagaaagacaaaatttttctggtgccgatgcgcttaggggagacacccgttcccatcccgaacacgatggttaagacttaagcggccgatggtactatgctggagacggcatgggagagcaggtgggtgccagattatatatgggcttatagctcagctggttagagcgcacgcctgataagcgtgaggtcggtggttcgagtccacttaagcccattggtttgtaaaaccagatgattaatataataaaagaatatagagattgcctttacagggtagactcacatccaggtattttggggtgtagctcagttgggagagcacctgccttgcaagcaggggtcaagagttcgaatctctccatctccatttgatgtagttacgaagtttgttttaattaataacgcttctgattacatcacgcatgtaccttgaaaaccacatattgaaatatatctagattagtttttatatgtcaaagtataaaaacaaaatcaagacatccgaggtgttacatcgcaagatgtaatcaaacaaaactcgttaaagtaaccgtaacgtacggtgaaataacaaacctaagaccagagatacaacgctatgtatcttagatgagtcacccgcacccgcaggtgaacatcgaattggttaagctaataagagcgcagggtggatgccttggcactaagagccgatgaaagacgtgataagctgcgaaaagcttcggggaggagcaaatatcctttgatccggagatatctgaatggggaaacccagctgagcaaacctcagttgtcgtatggtgaatccatagccatacgtcgggaacccggggaactgaaacatctaagtacccggaggaaaagaaagaaaactcgatttccaaagtagcggcgagcgaaatggaaagagcctaaaccggtatgcgtgcataccggggttacggactgcaataagtgagacgatttgttaccagaacggtcctggaaagaccggccatagaaagtgaaagccttgtatgggaaagcaatagtcagcgagcaggatccaaagtaccacgagacacgagaaaccttgtgggaattcgggggaccacccccaaggctaaatactacttagtgaccgatagcgcatagtactgtgaaggaaaggtgaaaaggaccccgggaggggagtgaaagagaacctgaaaccctgtgtttacaagctgtggaaccacattttaagtggaaccgcgtactttttgtagaacggtccggcgagttaccgttactggcaaggttaagcacttataggtgcggagccgaagggaaaccaagtcttaatagggcgaatgagtcagtaaaggtagacccgaaaccgggtgatctacccatgtccaggttgaagtttccgtaaaaggaaatggaggaccgaacgcacatccgttgaaaagggtggcgatgaggtgtgggtaggggagaaattccaatcgaacccggagatagctggttctcctcgaaatagctttagggctagcctcgtattagtctgccggaggtagagcactgaatttcctagggggcgtcaaagcttaccaaagaatatcaaactccgaatgccggccagatgatgtacgggagtcagactgcacgagataagttgggcagtcaaaagggaaagagcccagaccaccagctaaggtcccaaagtgcgtgttaagtggaaaaggatgtgggatttcagagacaactaggatgttggcttagaagcagccacacattcaaagagtgcgtaatagctcactagtcgagaggtcctgcgccgaaaatgtccggggctaaaacacgacaccgaagctgtggaatgtgtattcatacacattggtagaggagcattcttaacgcacagaagcattaccgtaaggagatgtggagtgttaagaagagagaatgccggaatgagtagcgagatggaggtgagaatcctccaggccgaatatctaaggtttccagagtaaagctgatctgctctgggtaagtcggggcctaaggcgaggtcgaaagacgtagtcgatggacaacaggttgaaattcctgtaccgcatatcatcagaactgtggggacacagaaccgaggaagaacccgggaatgaaaagaccggggcaagcattttactggctgggaggaaaatccgccagcaacaggaaggtgtgacgcgtaccgaacacaagtagggaagtcttcgtaggggctgtcaagaaaagccgctattgtgtgatatgtgcccgtaccgtaaaccgacacaggtggatgaggagagaatcctaaggccggcgggagaagcattgttaaggaactcggcaaaatgaccccgtaacttcgggataaggggtgcctgagaaatcaggccgcagagaataggctcaagcaactgtttagcaaaaacacaggtctatgcaaaaccgaaaggtgaggtatatgggctgacgcctgcccggtgctggaaggttacgaggaggggttagcggcaacgcgaagctctgaatttaagccccagtaaacggcggccgtaactataacggtcctaaggtagcgaaattccttgtcgggtaagttccgacccgcacgaaaggcgtaatgatttgagcgctgtctcgacaatgcacccggtgaaattgaagtaccagtgaagatgctggttacctgcgccaggacggaaagaccccatggagctttactccagcttgatactgggattcggtactgcatgtacaggataggtgggaggcagtgaagataggacgccagtcttatcagagccgatgttgggataccacccttgcggtattgggtttctaacctgcagccatgacctggctgggggacaatgtcaggcggggagtttgactggggcggtcgcctccgaaagggtatcggaggcgctcaaaggttccctcagaatggacggaaaccattcgaagagtgcaaaggcataagggagcttgactgcgacaccgacgggtggagcaggtaggaaactaggacttagtgatccggtggtataaagtgggattgccatcgctcaacggataaaagctaccctggggataacaggcttatcactcccaagagttcacatcgacggagtggtttggcacctcgatgtcggctcatcgcatcctggggctgtagtaggtcccaagggttgggctgttcgcccattaaagcggtacgcgagctgggttcagaacgtcgtgagacagttcggtccctatccggcgtgggcgtaggatatttgagaggagctgtccttagtacgagaggaccgggatggactgacctctggtgtatctgttggtgatcaacaccatggcagagtagccaagtcgggaagggataaacgctgaaggcatctaagcgtgaagccccctcaagatgagatatcccatcgcaagagtaagaccccttgaagacgacgaggtagatagggcagaggtggaagcatggcaacatgtgcagctgactgtcactaataggtcgagggcttaaccaggttggtttaggtaagaggaaagaacggatgaaaatagatatgtaacaatgtgtggttttgagggtatatgcctcagtaatcctcgatagctcagtcggtagagcaaacggctgttaaccgttgggtcgtaggttcaagtcctactcggggagttcgtgatactcaagcgaagactatgaggagaacgaaatgtaagtccggccccatggtcaagcggttaagacatcgccctttcacggcggtaacacgagttcgaatctcgttggggtcactgaaaacaataaatttagaatttaatttatggcgacatagccaagtggtaaggcgtgggtctgcaacaccctgatcaccagttcaaatctggttgtcgcctctcttatgaaagcctcagaaacctgatagaataagggtttctggggtttttgctttatagttttggtgtttgcgctggtttgcgtgggcatttttggtacttttgagggctgttaatctaggattgccctcatttttgatgctgtttcttcctgggaagtgatattccggaggtagtggtgcgtcatggtgagactggtatggcccaggagcttctggagttcagtatcttccattccatttttgtacatgatggatgcggtggagaagcggagtttgtgggaagagcggtattcaatgtttaattcttcgcagcatttctttaaacggcgattaaaggttactgttgccaagggctggccattccgaatgaaaatgtattcactgtttggatttagagtctggatttgtgttagaatttctttggctttcggcgtcaatggcatataacgtttcccttcgcttgcatggcctttaatatcttcaatgatttcatttttatcatctacaaagcgttggatatgtagaaaatcgccagaaatgtcatcccatcttaaccctttcaattcgcctattcgcagaatgaggtaaaaatccagctttattgccagagagtaaaaatcatctcccaagtgatttataatttgcagacgttcttcttcggtgtatggggtaattttagtattttctgccttatagctgaactgtttacagttgatgtctcgaagataatttcgttctataatatcattttccactgcaaggtacaaaatcccattcataatactttttaggtcattaaagcgttttcttgtgatctggcgtccttttgtaatgttcctgaaatagataatcagatcctttgctgtcaactcctttaagggaatcaaggtgatatcctgatccttcagtaaagaattccacataaagcgattttctctaattgtctttctacttacgcttgtctccttttctctccattccatccaggtttcaaaatatgtttccatggtagcagcggtagcaccgaaaaactgttcatacagtttttcgattaaaccctcataagtactacagcttattggctttctttgaataataaaatactttcgtccgtcatcaggtctggttttgatttttgatagatcacaaactctttttaactgcttttcttttgattttatattcataaaaattatgtgtgccggtgggactatcatagcactatgcttggaaatgcacaatcttattttgttgaatagatggtttattttttatggaaatttttgattgttctagtttaccaatgtaatgctaaccacattaacacttaaattcattgcatgagcaacgagaaaaaatgaatataatgacggagaaaagaaaaaatcagtatatacggaatgcatcaaaaaataaaaaaatctaataaattgctggaagagtgaagagggaaacaaatgagttatgcagtgtagctgacaggatatgaaaaagttaaattttatgctccttttatttttttaataatgtaagaaagttttattggctatttagccagaggaaagtactatgtgtcttgtttagatggatatggatatacttgaataataaggtaacctgtgatagtatcgaagtatagtaggtgtattatacacttttattttgttgcaacagaaaaaatagtaccaataaaagaaagtgtcggtcaagaggaagcggtttttgttgatcagctatcgcaatcgtgattttgattaacaaccaaataaagcaagttgttttaccaaatcttacatttataatagaagggagaatgttctatgtacttattaagctcatttacagtaaaaggcatgactctgcgcaaccgtatcgttatgcccccaatgtgtatgtacagtgccggaaccaatggtatttcaaatgaatttcattttacgcattatacctcccgtgcggttggtggagcgggactgattattatggaggctaccggtgttttgccgtggggtcgtatttctgaccactgtctgggactttggaatgatgatcaggcaaaggcgcttgctccaattgttgccgcctgccagaaacagggagcaaaaatagcaattcagcttaatcacgcgggccgcaaatgtggagcccaggaaaaagcaatttacgtacccagtgccattccttttaatcaggattctcccatgccccatgagatgacggaagcggatattcatgatacggttaatgcattccgtagctctgctgctcgggcatttgaaattggttttgatgcgattgaaattcatggtgcccatggttatctgattagcgaattcctgtcgccgttgaccaaccatcgtacagacggttacggtggatcaacggaaaaccgatgccgtatactaattgaaatactgaaggcagtacatgaggtctggccagatgaaaagccggttttattgcgtgtatctgctgaagattatgaacccaatggtatgcatatggaagaaatgtccgaaattattgaacttgtgaagccctatattgacgtgctggacgtgagtacaggaggagttgtttcaacaccgccgacgaaaatctatccaggctatcaggtgaaaattgccgagtggctgaagcagaaggctgggttgcctacggttgccgttggtctgattacggacccgcatcaggtggaggaaattctgggtggagaacgggcggacctggttgctttgggccgggaacttctgcgtgatccttactgggtgctgcatacggcccgtgatctgggagttgaatatccgtggccggagcagtatttgcgtggttttcaggcaagaaagtgatgtatgcaacgaatttatgcgccaggcagcttcagttatttattgcacgagttggaatctaatttggatttccgcaattaaatacttttgctgaaaattattcaaagggtagtatctgatgacaatatcggttgtataatcatcacgcttgatcttaatcatgcacttcggatagccggcagtaatatcctaaaacactttggcgcttacttttctgtgcttcaatttcagcataaaagtaaaacaatgatttcgttttcttttttggatgagggatagtgtatgtgaaatagtaaataagacggtgccggaaggagtagtgacgatctccaaagccaccacttatgaagcaataaaaagaaaattgtaaatttaattatactaattaagaggtggttaagagtgaaacaggaattacatgtcttttttgattatatctgtccttattgcctgaaggcacataaatatttaaaggagcttattccagagtattcggctgttactatagtctggcatccatgcgaatcgcatcccagaccggatcggtatggcccccacagcgatctgtgcatacaaggatatttttatgctgttaatcatgggattgatattttagaatatcatgaacgaatgtatcaggcagctcagaaggagagtattaatattgaaaatattgatgctcttagtgagtgcgtcagtgatttggttgatgcagatgactttcggttgtcactccagctgggaacttatcgcggcaagctggacgagtctaacaagcttgcttttgaaaagtctgatgtatgggcagttcctgcatatagaatgggcgctttaaagcttgatgcagttgaaaatgtgggtgtttccaaagagcagattttgcatcttataaagaaccactgcatttaaaattttttctgtatataggatcttctatgataaaataataaattatatgaggccctaaagtatgtatgcttcgcttgaatcatttctatttttcaaaatagcaatgcagttcgggaaattgtaatattaatgccaattgtcaaactgcctgaactgccattcaaaaatgtaatactaaattgtatgaatacaagtttgctgttaatctgtttaatttcattatagaaagtgcatgaaacctcttaggattggaagttgagtccaatccgtaaggggttctttttctgcataatcatatgcaaaatgctgcataaagtggaatggaaagcatattctcagttttgccgaaatttttttcggagaagcgaatggaatagctgggtttatacttttgaataaatacgctgagacttttagagtgaacctttgtcccctttttgacttctataccgatgacctcggaacctttttgtaatacaaagtcaagttcggcactgtgttcacttgcccaatagaagagggcgtgtccattcgaggccaacgcttgagcaacgtagttttcggtaacagagcccataaacacatttgattctccagtcaggatcgtttgttgaggcacaccagatttcataacaagaagtcccacatcactcatataaagcttaaaagaggacaaatctgcataaacagcgatagggcttgtgccatgatcaatcttctgacattttaacacgatgccagcctgtgccagccattcgattgattcaccgaacagtgctgcactgccgccacgttgaacaaccttgtattggaactttttattttcttttgcaagttgagcaggaatggaattgaaacagctgcgaattttaacagtatcagctgtagtagcgtattttgccatgtccgctacgtagttgtttgcgatttcattttgtacagttggtacaagaaccaactttccggagtttgtaaaagtctggacacaggcaggcattccaccgacaatgagatagtacctgtaaaattcgatagctttttgatggagcgcctctggcagcggagtcatcaggtcaaaggcagagcgaatttcctgtgatagtcgctcttcaccgtttgcccaaagaaattcttcaaaatccagtggataaagtgtcatgctttctaccttgccaacgggaaaggagtaatgttcccgatggattgcaactccaagcaggcttcctgccgcagcaatgtggtattccggtgccatttcacagaagtattttaatgaggtcaatgctcgttcacaagactggatctcatcaaaaataatgagggttctgcccggtgtaatgacttcatttacggttgtttccaagaagcgaatgagccgttccggggagatatcatcggaaaaataagaagcaacggaaagattggtttcaaggttaatgtaaacggtgttatcaaactgtgtttcaccgaatttggtcagtatataagttttgccaacctgcctggctccatagaggagcaggggcatccggttttcggttttgtttctccaagtaaggagcttttcttcaatttttctacgcatagcatacacctctctatgatagtatattacgattttaatatttatatgtcaagaaaaataaaattataacatatttttatggattaaaaggttaataataagcttttgatgaataatctcgagttgctcaacgacattggaattaatatcattcagtttatatatatgaaaaatgggagcttgtatttattcggtaaaatagacaaagttataaaaagtgaggacaatcagccaaggattgccctcatttttgaagcggtatcctcttgagaagttagacttcgaaggtagtgatgggtcatgtttaggctggtatgacccaaaagtttctggagctcagtatcctccatcccatttttgtacatgattgatgcggtggagaagcggagcttatgggaggaacggtactcgatacctaattcctcgcaacatttttttaagtggcggttaaaggttactgttgccagcggctggccgttgcggatgaagatatattcgctgcccggattctggtgacgaatttgttccaatatcttctgcgcattgggggtaagtggcatctggcgctttccttggcttgtatgtccctttatatcctcaataactttattttgatcatcgataaaacggcgtataaagatggtatcaccctttacgtcttcccattttaacccttttagctcaccgatgcggagcaccagatgaaaatcaagcttgatggccagatcgtagaaatcatctcccaagtgatttataatctgcagtcgctcttcctctgtataaggttttatgttattttcctctgctttaaaggcaaattgcttaaaattaatatctcttaggcaattatggtcaatgacttcgttttctacggccaggtagagtatgccattcattatactctttaaatcattgaagcgttttcgggtgagctgacggtctttagtaataattcggaaataacggatgtagtccttaacagacaggctgtttaaagggactttagttatttcctgatccttaaggagagcattccacagaaaacggttttcttttatagtcttttctgtaacactgctttcagatgaccgccattgcatccaggtctcaaagtactctttcatagtaattgcgttggtgctaaaaaggtggtcatagagtttttctaccagacctatgtagttggtactacttatgggtttccgtttaataatcaggtagattctgctgtcatccggcctgagctttatttttctgaggtcgcagacttcttttacttgggattctttttgattgaactccaagattgcctgacatgctgcagtggttagttttccgtctggatagaaaatttgcttttgcagttctgagatagtgtcatttaattctgcaagaggtgctgacggattgcttgtcagtattcttacaattatttcgttctgttttttgtatgggcttacggaacggcacatccgccatcacctcctttcctttggatacatctaatctttgtttggttgtttcaatagatcataataataatatctgaatgaaagaattgactattacaataactgttaaatgtctgctggaacctttaataatatctgcttggacctcattccggccgaagtgtttttggtgtatgccgcaatgcattctccaagcttcaggtttttcaataactgggtccaattgttattatttggatcgatttctttagcgattcctttaatatcacaatcatttggcttgaagtatatctttgttgaggcttgttgtattcggcttatagcagtctttgaaaaattattatttatgaactgtgttccaagccataaaccaatgcctacttttctcccttcagttagcatccgggcaattggagagtgagaggaatggttaaagagctgagcttcgtctaaaataataaaggtcttatgatttatgttacctcttaacgtggcttgattccagatatgccacaatataatatcagataaaaactgctttgtttcatcggtgaaaaattgcaggtcatagatataaacataaccaggtttataagcattgaagctactcttatccaccgtgaaaattttttgatcaaaaagcggcttgagttttccatataagctattagcatgtgctcccctggtgtcatgtattaattcaagtaaagtttgaatcttatgttcaatattgccaggcattatagtcatcatggatagcattacctcatacaacgtattttcttgacggcttccaagacagagaacatgggaaaaaagttctgtaactctaagagctgtatcaaccttcctttcctctaagtcagtatctaattgcaaagattgaaaaggatttatatcaataccatgctggtatacatttatagttacgggagtgattgcggatgagaaccccatgctttttcttcttccgaaagtttataacttccggaagagtctattattattacaggaaaacctaaagccgcagcttgtagcgcataattttttagcgcatgagttttcccacttcctgatgcaccctggattgtcatgtggtaattaggcatttcctgtatattcagagaaatcgttacgggatctcctaatctagtgtgtcctaataacatttctttttgttttgtattaatcataaatatcatctcctaagctccagattctggttcgattgaaggctaccatttttttctgtgttggtggggtatgcttgggaaaatatactgtttttaagtatgtttttacccgtgtctgatctgaggtgattatttcagcctccgatagacttttaagtaactggttcactgtaatatgaaaagggaatatggagggtatgatataatttcttaaatcttgctcagagacgtataagaaattatcatcacagtatagggtaatattgcccccttccagtaaagtatcgtcccttaaccggttgattaatgtacagccagatatcaatgatcttaatccttcaataaagagttccggtatactttccatatcactggacatttcattttggtatagaaagtctaccagtagtgattctatttcattacgtgtaccccaaaagtcttcaattctaaagttatagtgttttaaaaacttttccataaaatcacatactgtcataaaaatagaatatgcgactccgtttttttcgaaggttcccaaaccagtttgaaggttttcattccatgcgtctgaaagcattttaattgtagtattaaagttactacttatgtattggcacaagagattaatgtaatttcccattgcacaggggttgcataatgcctcttttaacacaccaatgttaatatcactgctttcaatataaatcgacagcgcattttccataggaatatctacgatattttggtttgatatacaaacaagagaggctcgtgatgtaatttcaaaaccgtcataattgtatttgactccttctagacatacgttatgtatcatatcccaattgctgaccctcagcttttgcttataggtattacatgtaggattatccactcgtaatataaatggttcatcctggtttgtaagaacgttgcgcagcagtgtcttgaaaggcaaatccagggttgtactggtacctttatcattgttaaagacctggagtaatgactgtgaaactttttcaatatttatggggccattggtcatttggagatataaaaatttgtctaatgcccacatatctgctttgtccaatactccacgcaaaatagacatatgaaaaaatagactaatcggaatagtcgtttccttttttaataaggacaatcggtggaaatatgatgctattatctcagttggctctgtaatattggaaagtgcaagttgtctgctgttaactggcattttaagtaaatccttaggaagcaatgaaaagatttcataatctgaagtaagaaatcttggagatgcattactaaaggaccagccagcgaaatacgggagacaaatagatgtagcttttgataacttttggctaatataatcacttacaagttctcctttgcgtgaatcgctcttgtcaataagaaaagaaatggagatattacgcaagaaggttatcgccctgcctggggtaaaatccttacgcttcattgcgcatactttttctccgcattctgtccctactttcaataccattaaataaatggtatcaagtgatgcgaactcaggaaactcaacgataattatttgggtgatgataaaattagcaaaaggctgattcataactgtctcatttttcaatccctttgttttacatatgagaagactattaaagggagtattttcgatgagatattcaaggttattacccctactggctaattgcctttttaaagactcgatttctttcctttgattatcagttaaaattgatagctgagtattttcgtaataaacagcgcttggagggtaaaggaagttttgatacggaatggattcatatggcatggtagttctcctttctcaaaatgagttggtctgaataatagggcatattttccccaaatgtaggctaccacaatagtttcaatttagcattcgaatcgaataacggttatgaatttcattaaaaccaatattgtgattatcatcacagttatgattttcaatttgaattgaataacagctataaatatctccaaggacatgttttatattgtttttaaggaggagttggtttaatattacttacaacatagataaaactaaggaggaaattaaatgagagtaatagaccttaacacatttctggaagatgaaagatggtttcccaatgacttacaaagacgtataggggaatcatgggaagaggcatcaagattatgtaatggctcttctattgaagatatatggaatcttttggtgaagaattgcttgaatagttggtttgttgaagaaaatgaacgatataatcttgaaaaagtaatgggactaataaaatatgatattattctttctgcttgtatttctttcaattttgcaataattccgcaaaagaatataggagaatttgttattgatgttctgaaaggagacccggactttaaagatgaagagatattaaagcaacttataaagacgcctaatttaaaaactgatttgggatataagtggtcgcaaagaagaaaagcgatactggataccatagataaagctgcactattatttttagatacagaaaataatatgattcccactaaggaattgtatatctatgtgaggcagttttcaaggtaccacttaagggctgatgaggaaaaagaggaatataaatttgaatatatgaatgcggaattgttttatactcttctcaagactagaaacagacttccttttacctacattgctcagcgaggtatgtatattaataagatttatgatgaaatttatgattgttttagccttttaaaaaacatttatcaagatcaagggtattcgattgaaaagattaaggatacatttatgatagataatttcctgtcattttctacattggattatttgagcactcattatttagagcgctttacaaatttgtctacctataaacagagttattcacctgaacaggctcaatctgctttatatttttataatttccttttcccattaccatatgagatatgtaagagtgaagtggacggatataataatgctattgaccaatttttccaaagtgataattgtaaatgtcgatggaagatattagagccttatatttcaaagtacgtttttattaattcctgcttagtgccagttattcagacaatattttcaaaatatttgcttatgaatgaaaatgctacgcttcagaacctggaaccgtctttgcagaaggttgccataaggttagaaaaatatatacttaataataaggacttttcatactatcatgatttagtggataattcggtagaaaatgaaagagttaaggattataggagatatttgaagcatttaagtgaagatgttgggaaaatagagagtacgtacagtaaagacgataaagaaaaaaagggtaataaaggtgggggttatcagaagcaattagaattcaatatagcgtattatttttattttataaggcgtgataattttgtggaaaaatgtaggcgttatgctgatatggattttagcaaaattatggaacgtagacccaaggtgaatagaacttttgatgaatttatacaccagaaaatagaagaagccatgcttgagtatgatttaattcagcgctcaaacgattttcctaaaacaaagcaatatacggattttataaaaggaagcaagaataggaagatttaccctgatctgaaaaaataaaataaaaaaggtaataaaaagtactcctataataaggattaataaaataatttttttaaattatgggtaaaccccctatgaattaagtttcatagggggtttgtgcataggtgtttatagagaagattttcttttcagatattcttcgaccgaaactttaggtattttccaaggccgtcccatttgaaatcctttgatctggtttgtttgtaataattcataagcacggttcctaccgatacctaatatctcacatagttcatttgcagaaataacatcatcatattgttctaacatagtcggtaatctcctttaaaatttattttattaaatagttataaatcttctaacaatttaataaatcattgggaagcaataaaaagctataaaaatccctatgataattttataagaaaggtacagacaacaatgaatgtcagcgtgagcttagacggtacacagtatcaagtaaagccagataaaatagaaatggctaaaataagtataagaattgcaaagaggccagttaatttgccgctggaggaattggcttcatatgtgggtaattatggttgctcattttgtccggcagtatttaataatggagaaagaaagtcagatgcatttagtgaaatgcaaatatttgctcttgattttgattcaaaggttacctttgaaatgataagaaccagagcagaaaaatatgacttgccaatagcgtttgcctatcatacgtttagctctacagagttatcggaacgatttagagttgtatttattcatgaatgtcctgtaaataatgctattgcagcaaaggtaatacttgcattattacatgaagtatttttggatgctgatggacaatgtaaagatgtttctagaatattcttgggaggtaaaggtctgatatattttcatgaagaaacgtttaatatagcaagtttggccctacaatatcagaaatacgaatacattactaattattctaattattccagaaaaataaaaggattcgcaaaaaagaacaaagtggctttaaacggttcatacttagaaattggccgcgcatcacaacttggtaggattgaagatttttcggaaaaacctatttatattataataggaaatgacgtaaaatcttcattttttattaaaatggcatcctaccagactggtaagcgcgataataaggtattaaatgatcaaattagggttaaatggtcagagaacggaaaaaaatgtgcgttatataaggattttctaaatggtgtggagcttgaacataatgaaaagtttttgctgttgaccaattttgttaatataagagggggaaggagtaagtttctttcatatattgaaaagaggggcgataatctcaaagattggagtttttattttggatatgctaaatccatgggatataaaccgcagctttgtgagaatggttgcaagtattgcaactattgtaatcataaagcaaatatgctgctgacaatagcagaaagagaaaagattcagaggttagatgattctaaaggatatgttagcgtggaaaatgtgtatgctcatattgaaagctgtctaaaagatgctatgagtgagattagagatgggctatatctaatcccagcccagaccgctgccggtaagaccaaggcatattgcgattttgtacaatctttaaaaaatgagaagattataattgcagttcctacaaacttattaaaacaacaggttgtagaagaattacatatacgaggaatcaatgctgtagttaccccttctattgatgaaatgaaagtgcccgaggaactggttaatgaagttaagtattattatgatattggaataaacagaatggcagccaaggttctaagaaaatttattattgatcatgaggaggaaaggaaccctgaaataatcatggcagttcaaaaatgcaaagagtatttgagtttttattcgaatataaaaagatttgaatatattgttacgactcatgcaaggctacttaccttatcagatgatgacttaaagggttataccgtcattattgatgaggatattttgttatatttatttaaaaatataaagaaagtcagcctaagaactatagaaaaggtactgtgcttggatcattgccctttggcgttaaaggcattattgtcacagattaaaggtacaaaggacaatacatataaaactgtgaccccgatgtcagaagaagctataatatcagaagatgacctatatcaatatggcatatcggaaaacgttaatgatttagtacaggcctccgtctattataaagaaaaaaatggtgatatacagtacttctgccctaagatgttgcctaaagcaaaatatataattttatcagcctcattatcaccagaattgtacagacaatatttctgtggctggtatgttaaagagtattctaagaaggaggccaactatttgggtcgtcttatacaatattcagctcattccatgagccgtaaagatatttttaagagaggtgacaaggcaatggattcaattaaggatatttgtggagatattccaataataacattcagcaaaatgggaaagggttttaatgaatatgaacttcattttggaaatactgaggggataaatgcttttacaggtaaggatattgctgtagtaggcactccacattatgcagaaacagtttataagctgattgcattccatttaggaattgatgcttctgatgcattgcattggcaaataataaaatatagaggctataaatttgggtttaccacatacaataatccgatgttacgagagatacagctttattttataaaaagtgaactagagcagagtatcggacgtgccaggctactaaggtttcctagtacagtttacttgttttcagattttccgtgtgaacaggctgagcttgtgcaggaagaatatataaaagagatagagcagtaaggtattttaaaataaggtgtttacgcgccgtattatagtatcttactctttttgattttaaatttaataaaaagaataatagaatatagcatatagtttggggtgatcggtcttgattctgaaaattccgatcatattatatagagagcgaaaaaacggggtataggttgttctatatgcttttaatgtgagtgcaggcaaaactgtagtgttggatatgatggttatatatagtgggctctcatatataacttagtaagataaaaaagtcttttttttattttcagatatatattatatccatgttaatctgcagcatggctgtatgaggggaacataggaacatagaaagccatagtgtacagaagctatggcaccttttatgctattaattagtaaatttggcaatgattttttattgctattatgtaaagttgactacggccaattatatattattgaagtggtgctgatagttgatgccagaagttaaatttatggatagggaggttcgtagaaatgtaatatgaagaattataagagaaaaaataaggatattgacagaagaaatagtattcatgaaacccttataataggaaggcaaaggaggaagattcatggatgcaaaggatttttatggtatttaccgggatctggcagagcaattgggagtggaaactacaatccgtatctatgagcatctacatggattacagattacatttccagtgaaactatacagcaagtcatatattgagaagcagataaaagaacgttatgacggaacaaatggaaaggttttagcgaaggagcttggatatacggagcgatatttcaaaaaaatcttagtgtcctcaaatcggagcgaggatttaatgccataaaatgaaaaaattgaggcaaggaaaaacataagtaaagagaggctgcctcatatgagccttgactcattttcaggcatcctctgtcctggatgttagttccatataagcattctatctatggatggcttgctgtgagtacatactgtgggtcttaagacggttccttgaaatcatcttctatttcttccaatgcttttacaaaggccagtacggcttttatttgccccggattcagtttctctatttgtaaaattgctttcttatggatgtctgataaggacttgtttttccctaccatttttaacttgggttctgttccatacagaatccaagaattattgtacccgtatttttcctcaattaatgtagcaagcgcttgagatatgttggagtttcttccatttaagagggcagatatatagctctctgttaccccgatttctttggccaaatctttttgttttaaatggttttcctcaagtagtaatctgattctttcgcttagattcaaaattgctcaccgcctttgttcaaaataatatcatagtaactaaattcagtcaagaatgtaatattgacaactaaattcaatcatgataaactaaattcaatttagattaacgtgattaaaatggaggggaatatggagccaacagagaaagatattgtaataaaaaagattatggaattggaaccggagcaagtatccaaagttttaatttttatagcaggtttggaggccggggaagacctaaaaacaaaaaatggaatagaaaaaaagcaggactgtaaatgtgaatgattaaaggtgggtggttatatgtgggggcaggaaaactgcgtgaagtaatagtctctatttgcgagagaggtgttcctccataaatagggacaggccagaaatgtttttacatatgctgattgagttataacaattatatccaggaggacaaaggatgaaacgctttagaaaacagcttgcggtcgctttggttaccacaatgatggtcagtagctttagttttaatggaatagcagctgagaataaggggaagtgggaattaaacaacggggaatggaattatagagaaaatggtgagattataaagaaccaaattctccaatacaatggtgaaaagtattatataaaagaagatggaatcatggctagtgacgaattctttcagccgaatgatgggggaacccggtatgcttttccagaaggcaaaatagcaagcggatggtggctttatttggatgatgaaggacatcagcttcctgacttgcagaacggtaattggtattacttcgataacaatgggatacggatggaaaactccacacccaggatcggtaaatataggtatgcttttgatgaagatgggaaaatgctgtcaagagctttcctggaggatggaaagaagtattattatgagtacgatggacagatggcaaaggataaatggctgaacatcgatggtgactggtattattttgaaacggatggttcttgtaagaaagcttcaaaagcatctgattctaatgcttctatggatgagtttgatgaagagggaagattgatttccgatacgactccctgccgcacaattgaagatattaaagtgaaaggcagcaatgaaaggaatggaactatcggaaaagagttaaaggtaacctttaatgtagaacttgcgactgacagcaatgcgaagaaacaaacattaactggggatcatgatttctggatagaagaggtgggctcctccggaacttataaaagagggtgggaaaaatcccttgatggaggaaagaatgaatataccatttcttatataccgtatgccatagagacatttcaattaaaattagtgattgatggaattgaatctgacccggtaacaataacatctgactggagttcaggttcagataaaatcggagggataggagataccttatcaggaaattgggatgtatcgaatagagtagcttctataaaaacattgtgtcaaagtttagacgataacagtcagattaaagaaacctggattaataaaatcagagaattgagagttatggataattcttttgcaatgctcaatcgaaatatggtttcaatagatgctgctggggtgaaatcacttttgggaacaggggagttagacttaattggaggaagtttaaatgctgctcagggagaggaaatcagtctttccgcgacaaaaggtactgtggcagctcttccggaagcctttgaaaagcagctctccgtcgaacttgatttgtacaaaggcggcgatgaaatccatgagcttgatgttccagtaattgtaggtgtgccggttcctagtggaatgagtgcagagggtcttaaagtattccatattggggaggacggttcacctgaattgctgaatacaaaaattgacggaaatatggtttatctcgttacagacagtttcagcaattttgtatttgcaggtaaagccgtccaagactcaagcggttcaaataattctggcggaggttcaggcagtggttcttccggtggatcaggttttaataagaaatccagcagcacaagctctattcccgaaacatctggactatggcaacagacagaaagcggatggagttttaaaaagcccaatggggatttatatcagaatacctggatttacgttaaaggaaaatggtattggattgaacctgatggaatcatggcacagggctggaaagaattgaatggaaagaaatattatctgatgcctgctatgggagaaatgctggttggttggattttagacggacaaaattggtattatacagatggaaatggtgtgatgcagactggctgggttaatgtaggagaaaagtggtactatctgggggcagatggacatatgctctcttctgcaaccactcctgacggttattctgtagatgaaaatggagtatggattcagtaactagccttgctgaccggttgaaaagggtatggcttaatcggccatacccttttcgatcaatgtagttgttttgcatatatctttaaatggtaattaaaggtctaaacaagattacaaaagtccttcttttgttatgaagcttagagtggatgctatattaagaggaatagagcattagagtcctctttaatatttatggagagaacaagtatgataaattattataaagtattggaagtaagttcagacgcatcagaagaagtaattagggttgcatacaaagcgttagcgaaaaaataccatccagatgtatgtaaagataaaaaaattataaatgaaaaaatgaaattaatcaatgaggcatatgaaacacttattgatctggaaaaaagagctgtttatgataaatggtttaatgaggaggctccacagccggatatatcatttagtcaaactggtgaagaaaaagaagaagcttcagtttctcctgcttcttatattaaaaggccaaagaagaagttcggaataataaagacaggcgttcttatttatatcgtatatttaggaatttcgtggtttagtgggaattccaattctgattctgtggaagctttaacagaaaccaatgttacagcatcaactacaacacctgcaggagaatcggaatccggtgaagtccaggctgacaatgtatcggtatggtcaacagagtatttatctttttatttgcaaaataagtcattggaaatatatgatttcagcaaagaagaaaagaatgcttctgtaatagcaaataaagtgaaaccagaacaatgctatataaaaggttcagggggatttttaaataattcaattataacctacaaaaagacggatgaagaaacggacttcgtttatatgggcgaaatcaaagatgagaaacctgatggatatgggatgctttataagttgataaattatggctctgattatgagcctatgcttgcacgacaggtggtttatgagggcatgtttaaaaaagggaagtattccgggtttgggaagtcatactttttctttcaggatgaaaatgaagcgtggaaatttggagaatttgttgggcaatcgggagatgcacaaaaatgtgtgaatgattattttaatgaattagaatatgtagggtattttgaaaatgggcaatttgaaggaaacggtatttttataacttatccagacaaattgtatacatcaacatattcaaaaagaatatcaatgagggcagatgaagatcctcaatattacacattagggattgtttcctccaatttcaaaaagggagaaatgaatggagaagcaaagctatattatgcggattatctgtcatatgatggggaagttaaaaaagacacaatggatggaaaggggaaactgtattataaaggcagtgaccatataaagtatgagggagattttttctatggagaaatagaaggaaaggggattttgtatgattacgatggaaatatagtagtctctggacaatggaagaataatatgtgcggccttataaatgctgaagattaccagtcgcctgaaatgacgcaaataatgtccgtcaaagatgtgtcccagggtgttgtagataaaatagttcctgaaacaagtactgatgcagataactatattctgccagatagtaatttacgctatataacgagggaagaaataacctcattttctaaagaggcacttcgattggcacggaatgagatttatgcaagacatggacgcaaatttgaatcagaagatttaagacagtattttgaaagccagccatggtataatggctatctgtcacaggaagagtttgacgatggtgtattaaacgaatatgaaagagaaaatttggatttactcaaagctattgaaaatggtcagactgatggtggagcgggttcttctgatggatatttagaagcatatagagagatcattaaccgggcatatggtcagtatggggaaatatatactttgtttatgatatagagcaaaatggaatcccagaattaattgtacaagaaggcaccagtgaggccgatttcatgtatgttgtttatacctacaatggaacggttcgggaggtgggaagcatttcaggaggacatagtatgatttatggtgaacccgatcaaaatgcgatcatttctgtttctggatacatgggatatcaagtggtaactcgaattataatcaaaaatggtatgctaaatgagagtacacttatggagggagatattgctccaggccaggactattattctactccgtatgatattccgtatgcatatgtaaatgatctgatcttgttgaactaatgcaatgtggaaaaaaatattattatagaaaaaatagtggaaatacgaattgaataaaagatacataagtttttaaaatacctggaggagaaaaggaaatgttgttaataatttattggattgccggatattgggctgttggaagaactgtttacgcaaatagaattgtgtttgatacatgggggaggattattattcaaaaaatgaccctggcgcttatcttgggatggttattgattccaatagcaattattaaggctttacttggaaaatagcagcctgaattttactaaaagctttatgaaagaaaaggtaactcatatatttctgtaagtattgagaaatcagtagttgtgcgtgctcccttagagcttttaaatattttcgatatagctttgtaaaagattctttggtaaatgataatcttaatttggtgtgggatatgtaataaaaagaatatgtatttatatattatctccttggatgtgaatcaataaattatttaaggaggtaatctttatggcagcaaatgtagaaacaatgttttacacaagagagaagccctggcatggactaggaacaatggtgatggaagcacctgcatctgcagaagctctggctttggcgggattggactggcaggtaattcaaaagtccattgaaacggaagatggtataccgattactggcttcaaagccaatatccgtgatatggatgaaaaggttctaggagttgtttccgatcgttacaaagtggttcagaatgaggaagcttttgcttttacagatgaattacttggtgaaggtgttacctatgaaacggcgggttctcttcaggaagggcgaaagacctggctgcttgcaaagcttcctcagcattatattataagcggggatgaaatcgaaccttaccttgtgtttatgaattctcacgatggaacaggcggtataaaggctgcagtgacacctattcgggtggtttgccagaatactttaaacctggccctggcgacagcaaagagatcctggtctgcaaaccataccggaaatatagagggaaagatggaagatgcaagaaacacgctcctttatgccaacaggtacatgggagagcttggtaaggccattgatgaactaagcagaattaagatgacagaccatcaggtgtatgaatatattgatgcattgtttcctttgcttgataaccctacggaacagcagcagaagaatctgatgagactgaaagaggatctgaagatgaggtattttgaagcgccggatttaaaatttgctggaaagcatggctggcgattcctgaatgctgtatcggattttgccactcatgcgaaacctttaagagaacgggcaaattataaggaaagtctttttgcgcgcacagtagaagggaacgctatgattgataaagcctatgagctagtgagggcaaggtgaaaaagcagagccagaaaaaaggtatcccagttgagccggaaggagggggtgaggagagatgggaagctttaagtaattgcagagattttccattcttggttcagaatgcgaatccggatatacttgatttgtttgaagtgcagattaaggaatatctgaatatgggtgagctatcagaatgttacttgaatgaagttcccagaagtgtatgctggtacgagggactcattgatactgcgatgttgttgatggaaatcgaagggtggggagtgctgtaaaaatgaatttgtttttaacatgaaagtacattccctatttccggaggaatgctgttccagaaagttcgttgatacaatattctcttatgctgtgaaagggtagtacagaagtcttgatgtgaagagagtgttttgtgcaagttattaaaaataaaataattatatagaaaacggaagcctctttcttaaatattggaagcttccgtttttgcaaggaggcgtgattatttatgaagaatgcaacgcaggaagaaaaggtaatcggtatgatgaagcgacctattcctaagaagagagtaggaatcataaagcttaaaatgattcgggatggaactgccgtttatggaactgaacgttttcatgaagcaaaagaggcagtggatatggtgaggcctctctttgaatattcagatcgtgagatgatgatggtaatgtcattggattcagcaatgacgcccatcgctttggaaatcatcgcagtgggaggcttgagctcatgtgggatagatccaagggatttatttaaacatgccattctttcaaatgcttcaaaaattatttgctttcacaatcatccttctggagagccgaagccaagtcgagaggattctcttattacaggtcggattaaggaagccggagtattgctgggaatcgaattgcttgaccatattgtgattggttcagagggcagatatgtaagcttccgggaagaaaggattgagccttttggaattgggggtgtggcatgaatgaaaaagttaatttcaacaaacggcttatctcatgaagattggctgaaatacagaaaacagggaatcggtgggtctgatgcaggtgcaatctgtggtcttaatccctatgtcagccctatgagtattttctatgaaaaaacaagctcagaagtagaagatcatgataatgaatccatgagacaggggcgagacctagaagaatatgtggcccggcgctttatggaagagacaggcttaaaggtacgacggtccaatgtcatgtatcagagcgaagaatatccctttatgctggcaaatgttgaccgccttatttcaggggaaaacatgggacttgaatgcaaaactgccagtgcctataatgcagataaatggaccggagaatctgtccctgcccattatgaaatccaatgtcatcattatatggcggtgaccggggcgaaggcctggtatctggctgttgtgattttgggaagggaatttaagtataagaagattgaacgtgatgaggagctgattcaaaatctgattgccatagaaaaggaattctgggaggatcatgttttgtcaggaaatatgccagacccggacggcagtgatatttcaaatgaagtgattaaccggtattttccaacggcccgtaaaaagacgattcctcttccgtctcatttaaatgagcagttaaaaagaagggaagaaatcattcttctggcaaagaagttgacacaggagcagaatcagattgaacagcagcttaagctttatatgggcgaatatgaaatggcatttaatgagcactatagagtttcctggagcaatgtggatacagtccgttttgacagcaagcgattaaaggaggaacggccagatctttaccgggattttgctaaatgcagccagtcaagacgatttactgttaaggcggcgtaatggtttgaggtttaaagatgtaaaggctcgagtttaacacttcacaggatgcttgttttgctcaatgaaaaaatgcagattgtacgtgtatcgttatcacgttataataatgccataaaatcatgacgaggaggacgcataatggaagcaatcataccttcatctgatttacaaaataagtatttggagatatcagccttaacacgggaatcccaagaaccagtttttattacagtagatggtcgggaggataccgttttgatgagccatgtccagtatgaaaaaatgaaaaccgagttggaattgtggaaaatgttggcggaagctcagggtgatgtggaaaatgaaagaactgcttctatagaggatacattttcggatatccgcaaaaatcttttagtggggaagtctcacgacctgtgatgtaatataatataaaggcggacagtcaggtaaatgatttggttttttgtgagatgagagagaggaatcatacaaaattgtatattcagttgttaatttcagatgtaattatgttaatttaatattttgagtattgaggagagggaccgtcttgctggatgcaggatggtccttttcaaattaattaaatgaactaaaatgaaagggatgagaaaatgtcagatgtaaaacaggaattagagaagagggcagcaggcggcggaggtcaaagtcaatccgtcagactgacaaaaaatatgacaatcgttgatatggttaaggctcttgaaccggaaatcaaacgggcgcttcccagtattcttacgccggaacgatttacgcgtatggcattatcggcgattaataatactcccaagctgggagaatgtactcctatgagttttattgcggctttgatgaatgcagcacaattgggtttggaaccgaatacacccttaggacaagcatatttaatcccttataaaaacaaaggagtgttggagtgccagtttcagctgggatatcggggcctcattgatttagcctatcgaaatgaaagaatgcaaagcgttgaagcacaggtagtatatgaaaatgatgagttttcttatgaactgggccttcatccctctttgattcatcgcccttcttttgatgaaccgggggagatccgggccttttatgctattttcagactggacaacggtggattccgttttgaggtgatgagtaaaagctatgtagatgcctatgcagcccggtattcaaaagcatttacttcggatttcagtccatggaaaagtaattatgaaggcatggcaaaaaagacggttattaaacagctgctaaagtatgcccccatgaagtccgaatttcagaaggctgtcactatggatgagacgattaaaacggagttatctgtagatatgagtgaggtttccaatcaggaagtgattgatagagagttgacggaacaagttgcataaatatcttgttcaaatgtttgctctactcaattgtattccatgacgtgcctatgatataatggtcttacttaagaggaaagagtgatgatatgtcaaccaatgatgccttgaaaatgttatatgaagagtgtttgaaattagagcctgatgaggctacacagttaattcttggggcggagactgaggaagaacaggagttttattccattgtcagcgacttcattcttcagcagagacagagaaaagtaattgaggagaatcgtttttgatgaaacgatatgttatctttgccggggtaaacggagcggggaagtctactttgtatcaaacattcccgcggtatcatcagatgcctagaatcaatacagatgaaattcttagaacgtttggagattggaaaatcatcagtgacgttatgaaggtatactggtgatctaggagttgaactattgtctgtcgtcaggtatttcctttaaccaggaaacaacactctatggaaagtccttattcagaaacattgaaaaggccaggagtcaggggtattacatcgaactttaatatgcaggagttgattcagtagaactggcaaaacagagaatcgtataccgagtatccaagggaggtcatggaatacctgatgaggatgtggaaaacggtattaggaaatattcctgaatttaaggcatgtttttcctatgtgtaatttagcttctttgtatgataacacggtgaaatttagaagaattgccatttataaagatgggattcctgttcgtatttcccataatgtgccgagctggtttcaacgtatataatagaaaatacccttgcagtatgagtctgcaagggtattttttgcgatcagagaggaggagataaggcatggaagatttactggaacagattatttgtgaacgtattgagatgctactaaatgtacgttctgatgaaaccagtcatgatgaaaagaagtttaaccataagatggaagaaattcttgaacggttggatggggagtcaaaagttgctatagagcagttttgggaagaatgggtcatgcgatcggcagaagaaagccgttatctgtaccttgccggtgtgaaagatggagtcaggattttagaaataattttaaagttatgagaaaggggagcagcaataatgaaagataaggatttcaggaatatattttattgaaaggaatttgaatcaaggttatggtacgctatagcggaagtgttggaaagaggaggaagactctggtggaactgaagcgaaatatttataataatctgctttgctggaagcaacgtgacagcggtaaggtcctggaactaaaaggtgccagacaaactggaaagacatttattctggataaatttgctagagaaaattacaaaatttatatctatatcaatatggctcagttgtccggggaacaatttctggtttgtatggaacaggcatctgcctggaatccaggagaaccgcgtatagaaaggaagctatatgaagctttccgattgttcgattcccggttcgaggataacaaagacactattattgttatagatgagattcaggaatcggcgaaagtgtattccaaaatcagggaattttcaagagagtttgtatgtcattttgtagttgcaagcagttacttagggaaggcattggaaaaggggtattttatttcagcaggagatacagagaatttgacacttaatacattgtcattcgaagaatttgtaaaggcatttggaaaacgggagctttataatgacgttgatctgcttggttccagtaatcccttacaatatgatgaattaaaagagtattataagatatattgtgaaataggtggttatccggatgtcgtaaattgttatttggaaacacagaatacacaagaatgcaaaaagattttgaaacagattattaggacttttatagaagaatcaacaagatgcttaggcggtatacaggaaatgattttactggagcagatatttcctgcgattgcacagctttctgtccgggagaaaaaggaacaagatgatttaattacagaattatcccgtattatttataatggaaaaagcaatagaaccataaggaaaagtatcaatgcagttatagactggctatatcgtgcagatattataggttattgtggcaaggccaatgaatgtgatcccgtgaacgtatatttgcacaaccgtttttattttctggatgttggagtatgcagatattttctggatgtggcaggagctgatttgccaactcttaggggagtgataagtaatggaacgtacaaggaaggggagattgatttccttataaaacgctgggaaaatgataatagctatggcgtgggggtaaaggatgggatatcagaaacagagacagtacgtcagcttttaaaagatgaaaaggtagaggctgtttatttgctgaaaggagatacttatggcggtatagcagaccgaaagataaccgtgcctatttatctggtgggaagagttcggtttgattatgaaagagggaatgaagagaagtcttgaataggatagaagttgtagtttgagttgagattatagcttcatttatgttgctttattttgcattggtaaatgagcgtgagattggctatgtgaagtgggtaaaagaataagtgatttttctgtcagaggcatttctaaggagatgcttctttttgttgttaaaaataagagtaagaaagtagaggaagaacaaatgaattacaatcagtttttagtggaagtcagagcagcagtgcaggaaagattaggaagagattatgagattcgcattcagaagattacgaaaaataatggaattgtgctggatgggctgattattgggaaagtaagtaaaaatatcgctcccacaatttacttgaattcatactatatgcattttacccatggtatgtcactgcaggaaattctggaagatattatatctgcatataaggaaaataatgatgtagtttttggtgatatgagagagcttctggattttaataatctgaagggtaaggtggctttcaaactgatccagagagaaaagaataaggagcttttaaaggatgttccatattttgaatttctggacctggcaatggtgttttatctaattctggatgaacatagaggaggacaaatgacgactttgatccataactcacacatggagccgtggggagtggagaaagaggaactgtatcgctttgcaaagaggaatactccaatgttgctgccgccggaaattaaaacgatgaaagagattgtgtgtgatattttaaagggatgtttagaggaattagaaatggctgggctggtaaatgatttgctggattttgattctcagagaccgcccttgtatgtgctttcaaataaaaagcagattaacggcgccgggtgcattttatacgatggttgcttgaaggattttgccgattctctaaattcagatattattatattgccgtcgagtacgcacgaagttatattggttcctgatgatgggaatttggattatggggagctgcagaaaacggttgatcagataaatgaaagtgaagtgcccaaggaggatgtattgtcagatatgatttataagtattctcggcatgattgtagtattagttttatagaataaaatcaaattcattgtatggttaattgctcctatggttgaggtccataggggcaactagtgaaaaagggcttattttttgtgaataaaaagattagatacctatattgcgaaataaaaagtacagttgtttcctaaatcaaaaaaattactaagtcaattgttttgctaagagtatgattttctataaaaacctttgtaaaacagtataaaacaatataaacatatagaagtataatattaatctctaaaaaatatcataattccagattaatatatattaatctgaaggaatattgtcatttaataatacctatgctacaatgataaaatggtactttttacataaagtaaattatgcttgagaggttagtagagtgggaactgatagatggctgtcaatgaaagaaatttgtgtacatctaggtattagcagagatacagctttaaagtggattaataaaagaggaatgcctgctcacaagattgaacgtctttggagatttaatactaatgaaatcgatgagtgggtaaaaaacaatggagccaaatagcgcagttaggagatacattcgcgatgtttaagataaagtgggacagcgaaaacaatgggatactattatccgagtatatagaagaaaaagatgcgcttaattcccccagacctgtatatgtagaagaatttagaatgttggggctagatgaggcttttcaattaccacaggaaaatgttcctatttgttgggagatggataggaagtattactattgtggaggagttatcgcagagactaaaaaaggaaacatttatgacgacccaacagttattgtaaatcctgaagcttataaaatggtattgaatccaattgatttggaagttttagtgaaggccaatttagatcagataacagttgctgaaaatgaggcgatggattttataaaagaaaagtatgagttttaccaagagaaaaatatttctggttatgtagttgcatttagtggaggcaaggattcacaagtaattttggatttggtaagtagagtgattccttctgaaaaatataaggttgtttttactaatacgggtatggaattgccatgtactattgaaacggttgaaaatactgaaaaattttataaacagagatatccagagtttaagttagaacatgcaaaaagtaaaaaagatgcattggatctatggaaagactatgggccccaagtcgtttgaatagatggtgctgttctgttttaaaaacggcattatttggacgaaagatgaaggaacttcttgaaacagatttacaacctaagctagttgtgtttgagggagttagaaatgatgagagtgcgcgacgagaatcatatggtcgagttggtgatggcgtaaagcatgtcaatttgattaactgccgtgcaattctcaaatggaatactacagaaatttatctgtacatgtacaagaatgatattaggattaatcctgcatatacaatggggctgacccgtgttggctgtggtgtttgcccatttgcatctgattggtctgaatatgtaattagaaagcgttaccctgaagtggctaaaaactatattagtgtagttgaagatatggccaagaatataggaatcacatctcaaacgaaaattaatgagtacatttcttctggtaattggaagaagaacgctggaggaaagggtcttattcctgatgcctcaagagtagatgtcttatcaaaagaacctaattttgaatgtattgtcttgaatcctaaggtagattgggaaaaatggtttttcacattgggagaatatttccttgagaaaatagacgagaattattataaaggagaattgaagtttaaaggaactgttgttaaatttgatgtcaggtatggaaagaattctatcagatttaaggcaatgggtacaactaataagattcttcttgttagctatttaacaaaagtttttacaaagacagcatattgtgagctgtgtggtgtgtgtgagattgaatgcccgactggtgcattgacaatccgtgattctgtcgagatagatcgagagagatgtatccattgtaataattgtttcggtattaatactaagggctgtattattgccactagaaagctaatgtatgaaggaggaggaacgatgggaacagctacaaaaacatcaggtatagataggtattcaacattcggtttgagagctgagtggctgacggctttcttcgaattaatggatggttggtttgatggatatagtgatctaggacccaaacagattaccgcaatgattaactggcttcgagaagcagaactagtggatttaaaagagaaaaaagtgacagatttggccaagcttttgagttcagtttatgattcaaatccgttgcaagtatggcagatcatttggattaatttgtctttcaattcttcgattgctaattggtatgttaataatactaagaacgagatggagtattctaaggttgaactggtagaattgctgaaggaaaattacccaacgcttaaaggggccactttgagaaatccggttgatgcattggtaaatacctttacaaattctccattaggaactattgataggggagatgatagcagcctaaaaattgggctactcaccaaaaagggggttgcagttaaaactattaggaggtatggtacttcaaaaatatcttcagcttcggtggcatatttactatataaaaatgcagaaattaatgatatgtacgaattaactgtttcagatatctatgaaaaggggtgtatgggagtatacaatgtttttaacatggatagtgtaagttttatgaatgcacttagaggcctgactacaaatgaagtattatcagcagatctattaggaggattagaaaatatccacttaataagtgagtttacttctttcgctgtcttaaagcggtttttaaagagggtataggatgaaaagatgtattgaatgtactaagggcctcagcaaagatgaggtttccctaaataaaaaattacttgggaagaacacgaaacaatttctttgcttggattgtcttagcaactatttaaacacagatagagaaatacttgaggacaagatagttcaatttaaggaagagggctgtacgttgttcctataggaggacatatgagatactcagatatagtaggtgtagaaaaacattttaagtctgctttcgatattacctcagatcgtggcgatgcttggaaaacatttatatccaatgagaagtttgaaaacaacatgaggaaaatcataaattgtttcacttcacctgtttataacaaccgcaattctgtttggattcagggcacatatggaacaggaaaaagtcattctctggctgtgattaaacatttattatgtgacgattttgatacaatagaagattatttaccaagacttaacaagacccagcttagaagtagcatcacaaattttcgtaaagaaaaaaaagtatttcctgttgtacttaagggcatatatgcaattactgatgtagcagatcttacatatgtgattcaacaacgtgttttagctgctttgaaagataaaggcattgaaatatcgacaaagacggattttcaatctgtgcttcaaatcctaaataatgggacgctagattctttttttgataatctgttggctaataatattgagttacatagttatgcttcaaataaggcacagctcatacaggtgttggaagattatgaaactaaggtcattagaattattgcagatgaattaaagagggcaggattaggcggatttagaacacatagcattgttgagtggttgacagaaattaagaaagaactagcagaacgtggaattgcagattatttaatgattttctgggatgaattcacctctcttttagatataccggcaagaagaagtatacttaatgttatgcaggatatcgctgaattaagcaaaacagaggtggagcaaggaacggatactctcggagtatatcttcttattataacacataagagattagaacagacagaaagctataaggaacttaaagaagatgagaggaccatggctaaggccagattcattgagttagattatgacatgcagccaacgactacttatcacatactggcgggggcattagatagaaagcaaccggttgtacttgatgaattacgacagaaaaatttgctagatattgttagcgtaataaaagtagtagatcaagttgttgatggtgatgcaccaaatgcaacggaggtcaaaaataaaatcatcagtttgtatccgtttcatccatatacttcttacttggctacttttgtttcaagggtagtaggagaggctgaaagaagtatctttggattcttaaatgatgaggataatggttttaagaaatttattaaaaatgaaattgataatccaatgttcctgaccgcggattatgtttgggattttttctataatacatttgagactagtccagctggtcattttgatgcaattacaaataaatataagttagcgattgagtctgtagaagcgaaaggggaaagctatgtatcagtatttaaaactattcttttgctgaatattttataccgcatgacgactacagatgcagattcatctgagaagaatatggtcaatccaagcacgggtaatattatagctgcgtttagtggtgcacttgctgaggctagggttaaagaaattttggatgatatagatgatgcccagattctccatagaaatccagatgggatttttgaggttgcttcatcagctcttccccaaaagaagatattggaggaaaagaaaaagctatatccaaataaagaggatgtaagcaaagtccttgaggaatattctattaagtgtcttggaaaattaaagaatagtatatctaggaatattgccagagaagttgatgtgcaagtattttggggcggagaaaaagagcatattttaaaaggacgtgttgaagcaaaatttaaagcatcatataaccttcatgtcgctctaattgtgtatagaggtgtgacacatgatttggatgagattttaggaagaacagaatccaagttagatgtatcccaaaacatgattttgagaatatctaaagaaccagaatttcaaaacatcgtttttgtcgcaaccaatacggaattaggcaataaacgttttgaagcatatatggatagtttggctcaagaggcagtagcacgttccctgcaaatggatgaagaacgtatcgagggacagaaaaatgcagaaaaatggataacgcagtgggttgatgaaattattacttctggaatggttgatttgattttccggggggatattcttcatgtaccttttttacagtgtaataaatatttgaaagataattatataaacactatctttagatatggccttgacagcttggcggttccaaacactgtctggaatcaccagactagtaagaaggcagttgagcttgtgctctattcacttagcaaatcgagtttagagcaggaagcaaaaggaaatgatggagcagtaaaatatttgctttcatttgataatacactactttttgatgaggcactaacacttatttctgatgatgaaaaaattcctgttgttaaagtgtgtaaggaagttcaacgaaaaattgaagcaaagaaaaatgagccttcaataaatttggctgaggagcttaagtttcttacaagaccagaatatggatactatcagaatagattatttatgggggcattagcttttgctttgaagccttattgcgaccgattatatacctctggaaatgggcagaggatcgataagacggtgatgaaagaggtaattgtctcaatttttatatattgggaaggaggtaagtttaatgacaaatttattgttagaatgagtacggaggaagaacgagaacttactgaaaaacttaatgccatttttggtataaaagataaagatggattgctgggaactaaatgggcaatccgcgataaattcaaaagtaagaataaggctcctctatgggcgttgaaacacgttggtaataatactgataagtattgtgaattcattgataaactgtttaaattttctaaaagcacagacgagaatattttacaggcgtttattatagatctcttggaagggataaaaacttttgatgttgaaatatccaatgcaatttcaagcgttgagagtgagaagtgtttggatgcttatattttgtctgaactaaagaaaatcgaagaagatggcatttcattacctgctgtaaaatcatttctaaatggaaaaatgtctggagacatcgttttttgggaagaaagtgatattcatgagcaaatattactttggaaaattaagaagaaagcagaggaaggaagtcaatcaaataatcagtctagtcagacaagtgaagatggaaaagttttagaacaagaagatgaagttggtagtaacacggataataatagcggaataacttcgcaagatgatgtcatgaagcgtgttggagacaaacttcttgcagttaagtctaatggagagaaattgtataatgttcttatagtattgatgaagaaatatagtaatattgcagaagaggtagataatttgctctaattagggggggattgcatggatatagatagtatggttgacattattcaaagtgatttaaatcgccaaggatcatatgatcgctatccaataagattttttagcatgaagttatcaaatggaacttcgaattatctaatgaagcttcgtacaaaagtagaggctctagcaaaaaattgtgtagaaattttggattttcaaaactttttactacacgatgatggttggattacaattgatagatttcgtaaaaagtatatgcattagactcagataaaagctatattattgtaggtttttcagaatatgctcgatttttatcaaatgcggaatttattactttattattaggcttgcttgaattggagaatagtggaaattatgttaaaaggcgaatatatattccttgctttgcaatttatagtcaagtaagaaagattgtgaaagccaataatcggcgcatggatgtgtataatcctttcttaaatgaaatggattttgaagatttgccacgtattttctttattgatgataacttggataattcagcttatgaaaatgaagttactaattcaagtgagtggtttggaatgtggagaaaatctaatatagatgttactaaacctattatttgcacttccaaagtcctttcactattttatgaaaaagccagtccagacaatgtttataatataaagagaatttcaacttatgaggaattattattatatttgtatggaatagaaaatattgtttcctataaagttgattcggatgagtactttaggcgtcttatgatgctcctgcgttcctcacatggaatgcagcttaaatctataattctgcaagtagtgaatgcccaaaaaattacagtagacaatatttattctttgtggaaagttgcaggaatctttgaaaaatggttgatccagaattacgtaatattatttaataataaagaatcatatcttacttatatgatgtcatcaatgacacaactatctgtagaggaatttgttgaaaaagcttatgtttgttttttggtgaatttagatgatacaatctatgaagagagaagaagattaattttatcagttaaaaaaatagaacatgatatcagatgcacaaagcaaatagaggagtattttgaaaagtttctttgtgaacttataagaaggcagacaaccatagcattggaaagcattaatatgactaaggaatcagatttttcagcggaaaatattgagaaaatgtccttggaggtaaaaaaaagactgttgcctattttaacggattgcagtagctatgagcgccaattgattatttggctcttccgatcaggattagtagaagaaaaggaacttaataaagtatattctaatttatgggaatacctaagtaaaagtgaatttattgcttctgaaggggattatccggctagatttgttgcttattttgatttatatagaaggtgcagattaggaaaaaatagcgggaatatatataatgactctttattagaatggaataagaatgagggttcattctatgagtggtacactagtggacagatagagtttccggaaagcacattgaaaaaacagaattttgtcggtccggtatatgttttagatggtgttggtgcagaattcttagattatcttttggctttgttagaacatgaatgctacgaagtggagtattgtaattatgcgaaatcgcatttaccatcagttacttctatcgcaaaggaattttatgattcaaaatatcactgggtagtagattatgatagagatgttattcatggagaaatttattatcatgctgcaaatttggaaagagcattatctgtcattgaaagaattgttaagcggattatatatgagcataaaaacgaaagctttgctataattgctgatcatggatcgagtgtcggtcataagctattcaaacgtgaaaagaaatataattatgatcagtctgatcatgacgggcgatgttatttggtgaaaggcaatcaaagtatcccatcatctgttgattatgtattatatactgatgaacgatctcgtcaatgggtaatttcgttaaatgagcaatcgcttttcaatacatccaagtatgaagttcatggtggtgcaacccccgaagaaattatagttccagtgatcattgcacataagagtaataaaaaaagtaggacttacaaagttaacccgaaagatcttaaagtgagtggaatgaaaaaagagttggagtttaaaataagccctaagccagatagtgctcaactaatggccaaggatggaacgaatataaatatgatttatgaccaagaaaagaaaatttggattggaaaattgaagcgtgggatagaacagacaatagaagtttgtattgaaaatcaatatttttgcttcaagacaataccgccaactaagatgggagatgatttgtttgatgactgagttagatcaaaagattcgggatatttttccggaagaatctatttataaaactgcaactcattataatatgtttaatgggattaatattccttcttttatcaaggactggcttatcaaacggtattcagatgagaatgaaaatgttgataaacaggcgttgttttcttttctggataagcatataccgtcaaaagacagtgatattaaaagtcggcttatgaaaggagaaacaatccaaattttggctagaatcattgtagagtcagatttaaaaaccgggttgtttaaattttcaataccggatattggtattaagagcaacgaggggcgcattaatgattatgttatgcgatctcaacatggtgtaattaaagaaggtgaaaactgggggatcgttacattggactatgtccaacctgaaggcaaagaaaaaggatatgctgaattggttaaattcaaaccctttaagccttatactccggactttgaatattactgcgaggcaagaaaacggttttctattaaagactggattgattttattataaaatgtatggagtataatccatattcaactcagtttgattcatatacgcagaaattattatttatctcacgtttactggtattctgtgagcctaatttaaatatcgtagaattggcacctaagggaacgggaaaatcttatatatttaacaatttaagcaaatatggttggcagattagcggaggcaagataactagagcaaaattattctatgatatggcggcgaacaagcctggaataattcctaactatgaatttgtctcaatggatgaaataaagaccataattttcgagaataaggaagaattacagggcgcattaaaaggttaccttgagcaaggaacatttactatggggcaggcaaaacaaacatcaacggcgggtttgattttacttggcaatattgatttggataataacaggcgaccagttagtaaaaagtatttccaggaactgccggaagtatttcatgacacagcacttcttgataggtttcatggtatgattgaaggatggtatttacctagaattacagaagatttaaaactagacggttattctttaaatgttgaatatttttcggaaattttatctatgcaacgagctatggcaaggtatgcttcagttgtcactgatttgcttgatattcctaagaatgctgatataagggatactactgcaataattcgtatggcgactgcttatatgaaaatattatttccatatgtagagtctgttggagatataaagagggaagattttgaaacatattgttttaagccttcttatgaaaaacgaaaaatcatcagaacacaactttcaataatggatatggaatacagtcctaaaatgccggacattaaagtgagggatttttgatggtaaattttgaagaagagttagaagagatggtctgtagtaagaatttaatgaatagctacaagctctatttcctaaaaactattttgattaatgcttcaaaggatcgaaggacattggagttttatgaattagcatgttggatgtgtgcttattcattttcagacgtatgtgccataaagcatcggattcggccattagataaactttttgatactgctgtgatgattattgaagaggaagatttgatggaatcatctaaagtttcagaggtattcgatgttgttcaaaatactttaaataaaaaaattcgtagaaatgttttgtcactatgcaattatgtaccatatcgattgctggcttatctttggccagaagatttgaaagggaaaacagacgttcaaaaaaatcaacttattgaagagtattcaagaagtgctgagcggaatctatatatgattttttcaaattcaactgaccagaaaagtatcgagataaaagaagaatggctaagttatattaataataacagaaaaagattagtggggtggatagataaaaaaattcaaaattttgtttggaaggaatgatattatgatttatgtggacaatgcggcgacgacaaaattggaccctgaggcttttcaagaaatggttccatatttgacagatttatacggtaatccttctagtagttatcgcttggctgtagaagcaagaaaggcaatttgcaaagcgcgagaaagaatagctaatattattggtgccaaggaaaatgagataatttttacttcaggaggaagtgaagcagatagttgggttattaatggatatgccaatataccaagcaagaagcaaataataacaacggtaattgagcatcatgctattattaattcttgtgaggcggctaaacgaaaggctgtaccagtaatatatctaagtgttgataaagatggaatagttgataaagaggaacttaagagagaacttatgaatgaaacctctttagtatctattgcatatgcaaataatgaaattggaactatacaagacataaatttgctatcagaaatagtacatcaatatggcgtgacttttcatacagatgccgtgcaggtggttggtcacgaaaatgttgatttaaataatttggaagtagatttattatctgcatcagcacataagtttaatggcccgaaaggtattggatttttatttaaaagagcgaatatagatatagaaccgattatttatggaggaaaacaagaaaaccatatgcgaggtggaacagagaatgttgcctcaatagttggtatggcggctgctctagaaaataatataaaaaagttaaatgatactaaagcacatattatgaaattggaaagttacgttcgaaatagattgcagcgacaaataagtgatattttgtttaatggtagtgtagataaacatatgccaggaaatataagtgtaacatttgtatctatagaggcagaggctataattaatttactggatctaagggggatttgtgtatcagcagggtcagcatgtaatgaaggattggatgaaatttctcatgtattaagaggaataggactctcagaagatttagctagtagtacaatacgaatttctattggaaaatataatacgttagatgaaatgagtaaattatgtgatgagattgaaaatatacatcatatgttgtcatgaagctaacttggttgttgctgagttgttataatattttttacggaagagggtaaaatagtgaatataattgagcaaattgggctggagatggatgacatggattttagaataagtgataatgatattgattcaaaagaaatagcattaagtgaattaacggatacacgtatcgccaatagaatttcagctatggatgtagaaacaattataatcaatctagagagagataattacgaaattcctaagtatcaaagaccatttgaatgggataagattaaaattactaatctaattatttctttgataaagtctataccaataccacctatttatgtttactttaatgaacaaaatgcaaaatatatgatactggatggtcaacaaaggatcacatcaatatttttatatttttatggattaggatatattcgcaatcgggtatataaacgaattgattttaaaaaggtctctgcgttgatgaaggaaaaaaggataattgaaaatagtacagacaaagaagataaaagaagaaaaaaagaaattgtacttgaattaaatcgtgattataatttgcgagaggaacaatatattgacgagtcaacaaaacaagaaatcacattttctaatctttcagaaaaggcacaacgtatattatatagaaaatctttaaatgtggtttacgtagaatgtagaggaaataacacacaaagagcatattctgaaatttttaaattattaaatagtgggggaaaattattaagcagtcaagagatacgaaatggtgtttatataaataattgtttgtatgatttgatttataatttaaatgataataatgaaaattggcgtaaaattttcgggaatagtgcagttagaaatgatatggaagctctgattagatttttggcattagataatttttctatttataaagatagtgctgttattataaattttaaaaaagcattttctttggcttccataatagatgagtattctgaattatttaatttagatgaaaataatggtgttgttaatgaagataaaaaaataatggcacaaaaagctgttacttcgatagaattatttttaagcatgattaagtttccaacagaaaaatgtccaccttgtagtattctaataatggaagcattatatgttgcttttagcaaattggggtatctagatgttacacatgaaaatctgtatatagattataattggattcttggattggatttatctaaagatttagaacttgataagtcagcattatcaaataagggaagtgtagaaaaaagattaaaaaatgcaattattttggtgaggggcaagttcaaaaatgaatgttaaaacagctactattgagctagttaaaagcattaagggagaaaaaaattttagaaataataagaatttagtattagtgggattgagttcatctgggaagtcaaaaatactcaaagatatgatagaaaagctatttgatgaaaacatatactttattgattcaccaaatcgcgttataaagacttccataggaacatttaattcctttgaggattttaaggtgaaggatgttttaacatgcaggaataaggaaaaatattttggtgcaaaggatgttttttcagaagagattggaactgaattaattttaagtgagctgaataaaaaaaagattttttataaaaagctttttaaagaggttataaataagagattaacatttgatgaagatttgccatttggtgaattgacagatgctatagaatcttttaaattggataatatagatttaaatcatatatccagtgggtatcaggctcaaattcgcatattgatggaggtcaattttgctgtagagcaaggatgtaagataataattattgacgaatatgatgctcacttagattttaaagactcaaaattttttttagattctttatgtaataagtatactgcaattaggtttataatagtcgtgcattcagcttatacgttgatagaacttgaaaattttgatgtacttaaaatatataaggaatatgacagaattgaacagaatgagtgtgtatattttgatagtaatgatttgtacgagctatctagcattcattcaaaaatatttgatattgaaagtggtagaaagaaaagagatctgatttttactgacgcactatcacaaaagattgccttaggaaacgtaaatgctgaatttttttgtgaagttgaaaaattagaaaaactgtcaataagagaaaatgttttattagaatacattaaaggatgcaagtaaaatgtatattgtttttccaacattgtttcatgtaagatatccgaaaaaaaataaattatattacaattctaataacattggtgaaatcaaaaagatcttatggatatcatctaaaggtttttgcatgtactgcggcagaaagatagatattgataatcaaatctattcagatatagaacattctgttgaaaaaaaaggtcaatatgaacaaaatggaaaagagtctattttaactcattgtaagttcaatatgtctttatcttgttctaagtgtaatcaaaaatataaaactagaatgctggaaagtattgaattagacgaaaaagattatgacataaaaacatgcttatcaaaacaatgttcgcgaccgtgcaaaaagtatataagactaaaaacaatgcattgtcattataataatattattttgcagccgggcggagttaagtacgagaatatacaatgtcagattgtttataatttagtaaagcatacatatgaacctatgtattggggaaaaaacaaacaatgtgatgattatatatggaatcatatttcaagatttcacttaaaccgtgaaatgaaatctgaatcaataataaaagtttgcgaatttatcataaatttatatgaaaattttaaccaggagttttcaataaaccagtttaaagttataatggacgaatatatatatgaaaattatttggcaattttatttgttgattatatagtacgtaattttcgacatgcgttgcagatatatgaattttgtaaatttattattatattaagctttttataatgtcaatagaagtttgcttttttgtttgcccccgcttgcgcaaacccatcccggcacgccaaaccctcctttttcctacgttttttgagcgatctccagttcaaatctggctgtcgcctctcttatgaatgtcttatagaccggttaaaataagggctcttggggttttcgctttttgctttcacttgtttgtgtgggcattttaatattttttatattaaccgctgtaacgatgtttatttttaaatctttttaggaaaatattacattttaccacctgtggggtatagtttatcatgcttccagcaagaagaactattcctcccaggatcctgagaattacaaatacacctttggtctctggtctacaggcctatttcaaataggtggcccaatacagttatgttcatggcgaatccaatgaggagcgccccgttagccagacctattgatcgtcaaaatataagggcagaagactgatcattataatatatgaaattacaatggtcagaccgcagcatatgccgtatgtaaaataggactgccacagtctttccgtgcggaagtacgcctaaggcaaaaataacttcagcggtccttagcaggatcgctgatggaagttttcgaaccaaaaagctggttatcagagatccaagtgcaaagaaaataaagcacagagtgaataaaaggaagtttcctctcctgtaaggcttagatcttttgtaatattaacgagctcattaaatattaccatgaagaattcctttaatttcacatctatggtcagcatcaggctgagctggaccctttcttagtcatcccggatgactggatactttaaagtcatcaggctgatctccttttttgacgtgtccttcataggcataagaaattgcaaaagtatataccatagatgtggatgcaaggtcttctcttagaaatacaaagtcaataacccctttattaacatagcccttgcagtgcagcctcccgcccaaaaggcgagtagcttccttttttgaacggcatccgcatttcagaatgaatattctggtattcactacgtggaacaggttggcataactgccgtttgccaatttttccgcttttatattacctggattggtagcgccccttattttgtttacaccattttaattaatcaaagaagtgacaataatcacctcaaccccccattttagcgctaccacaaaaataacaaaatataaaccctgacaatccatgttcttcgcctctcaatacaagaataatcctattaataatcatatcgccaaaaaatcaatttaaatttcacctccacaaactaagagatacccattcccataccttcgtccccatcatttccatcactaacataagcaaaatgaataccaagaaaaaacaaccataaccagccctattcatgcaataaaggtaagcgcttaataaaagagtgcctttaaaattaaaaacaggatcagttataataaccaaccctgagccttacctcttacattcactttgtacatccgctgaccacggcatcagatcatcaagtaattctggatggtttcgccaatcagtgtcaggcatgtaaagtaataaatactctaagtaggtatatacattaagaccatttgcttttgcggtctcgacgatactgtatacagcagcagacgcattcgctccttttggagtgtctgcgaacagccagttttttcgccccacggtaaatggacgaatggcattttcagctgcattgtttgaaatggaacatctcccatcaagaagataattctccatgtaaggtttctggttctttgcatagacaactgcctttccaagggcagatcccttgagataattaaggttatcaagccaacaccaaaaggcctcaagaactggtttttctagttcaagacgcttgcttaatcgttcttctgtggtaagatcttttaatccttcttcgattttaaaaagctgattgcagtaatcccttccgatttcagcctgagtcaatgaagccccctcggctttttttgtagagatggcttctacaaattttcttcgtaggtaagcccaacagccgcaacgggttattccggaaagtttgttgtatccggagtatccatctgaatggacataccctttgaagttcttcaggaagtttactgcattgtccccgtttcgagaaggctggtaatcgtaaagaacaattggttcttttccatcattaccggtacagtataaccacatgtaagatttcgtctgtggtttcttaccctcctccttaaggacttggacaggcgtttcatcgcaatggagaacatcgcgttccaacagcttttgctgaaggtggtcgatgattggtttaaaatagtcatccgagcatcgaataatccagttagccatagttgctctgcttagagcaatccccagctgttcccaatccttttcctgtcggtaaagagggatgctattgacatacttttggtacatgacatttgccacggaactcgcagatgcaagggaatgattcataagtgatgttggagtttctgccttcacaatatatggatgctcagagcgcttacatttcgaacattcataaacagtctgtatgtacctgacgatccgaagttttgccggaatgtattccagctcttcacgcagaacctgtgtaccaagtacttttaatggtgtaccacactgatcacagaactgctcatcttctggtagtgtacacggaacttctcttataggaagatctttgatcagttcttcgcgtttggtttttgtatttttacgtttataacctttgacgtcctttactataggctcaggaagagaagcatctgcttccatttcagcttcgttgaataaagaaagctgaccatcgatttcttcctttggagttttttcactggaagaaccaaacttctctttacggagaaacaggactatttcatttaagttgcttatctgattctgtaggtcttgtattgtgttttcgaggtgcatgatataagcctctttattgtccattatagtttcatccctatatttttgatacaataattataccacaaaagtagctaaaaagccagtaaatacaggcttttctggcactggaagctaacagaacgaagccggtttagctggcagaataaccgttttctgttccagttcaagaccttccatcagccagcggaactgttgccatgtgataggctttacgtcttcctccgagcgcggccagcggaagcttccattctccaggcgcttgtataaaaggcagaatccatctccttcccacagcaggcatttgatcctgtcacggcgttttccacagaataggtaaagtgatggggtaaaaggatttaagtgaaactgctcctgtacgacagcggcaagtccgtcaatcgacttacgcatatcggtataaccgcaggcaatgtaaatgtcctttgcaatagtaatatctcctaacataagcagttcagtgcaaggagcacagtctcaatgatctgctgcgtggcaccattgtgtatttcaagtgatgcagccggaagatgtatgattacagcagcttgtgtatgaataggtgtttgcacctccaactttttaaataaaaccggtttctccattggatcaggcagtgctacaggaatcttttcgatttcctgttcacgaatcttcttaaggtaataataataggactgttctttgaaaccattctggtcacaccaggtcttaacgggaaggccactggcctggcattccgcaatgatctttttccattgttctctgcggaataaaacttttgtttgagtaacttgatccataaatgcctccattcctagagcttgaaaaatttgaaaaactataactcaaaaagctctaattatatggaattaattatgacatggatcttaatcattatataaggcactcttttattaagcgcttacgaaaaaacaaccataaccagccctattcatgcaataaagtgttacacaatctgttcatagtgtttaaagcgtgcaacagaatgaacatattgcaaatgacttcatttatataaatctgccgtaaatacagtagaaacatactaagtaaatgaaattcaaagacaaaatctactctggcataatatttgcttgaataattagtgagagtaccggagtacacttttgcaggggcctataaccttgcatggtaccaaccgctatgataaaattgagggagattgagtatttatgaataatttgattttcagccttaactctgtagtgccagtatttcttgtaatgtctgtaggtttttatctgtcaaaaaagggaattgccacccagtcctttgtgaatcaggccacatcccttgtgttttatgttgcacttcctgccaagctgtttctggatgtttccggcagtaacttggcggagagccttgatttgagctacacggcatatttattaggaggtacctttggggcctttgccggagcgtggctgctggcacttttatttgtcaaggacaggtcggcggtcagtgcgtttgtacatagtgctttcaggggaaattttgtttatgtaggacttcccatttgccagaatattctgggaaaggaggtaattccttcggccataatggtaattacgtttgtgcttcctttttataatatattggcaaccattgtcctgtcctgctatgatccttcgggcagaaaggtcagctggaaaaggctgttaaaggatattgttacgaatcctatgattgccgccatcttacttgctctgcctttttcgctgctggggataacgcttccgtattcggtggaaaaggcattatcttacctgggacaaatttctactcccatggcacttttgtttatcggtgccggcatacggttttctgcttttgcaggaaggatgaagtggattgtgttaggttctttgtataaggttgtcatgactccccttatctttgtcatacctatggtatgggcaggctttgagtcagagcagattgcgacagcctttgtcctgttttcggttccatcagctatgaatgcatatatagtgactaaaaagatgggcggagatgatgagttaggggcggctgtgattgtggctaccatgctcctttctgtcattaccatgcctgttggcatatggcttatcaagtcagtgggaatcatataagggggattcatatgaagccgttttttcatgcagataatatgatattcagaggaatcagcaaatggatggattatgtatatgtaagctttctgtggttggtgttttctttacccctgattacggcaggcgctgcagcggcagctctttattatacctccaatcattgcttgaggtgtgacaaaggctatatttttaggacgttctggaaaagctttaaggatagcttcagacagtctgctgttgtgtctgtgatcctggctgttttgcttggggccatacacctggatatgaagctggccagcgggaaggagaccatgaaggtattccagatcgtgtttattgcagccagatttttaattctgatggtgtgtgtttatgtatatccgtatattgcaaaatatgaaatgaaattaatccaggtgattaagaattgtgtgtatctgagcatattaaatgttccgtggacccttcttctggtgttcatattgttggccgccatatgcctgacccacatggtgccatgggctgttttgatcatgccttcctgtgttggcgtatttttcagtttgattcttgaacaggtttttagcaggtatgcagatgaaagaagggagagggagtcttgagaaaaatcacatattttgttccgtattccaggctggtccctgttgtacgaagaattatggaccagcctcgctatgaaggaatattcacgaatgcatccatagagtattttcccaaaatgtatgatgtgaaagtggcggatgactgtgatctggtaattgccaggggctattccattcatgtaataagagagagattcaatggacctattgttgaaatacccataacaggcagtgatatagccaatgcgattgcacagtgcagaagaaatacggattgtcagaaaatagggctgattggagattattcaaatatgaaagatattgaatccatgagctgcctttttaatattgattttgctgtttatatgattgacaatccagaccagattgaagatatggttaagcgagccatagaggaaggatgcgatgccctgatcagcggcagtcatgcaaataaatgcgtgataaaaaatggctttaaggtctattccggcattattgagaatagcgaggaggcaattatgagggcgttggattcggcagcaggcctgattaaaaatatggaatatgagaccaatcagatggaactccttagacttctcgcggaaaatgtaacggatggacttatatttgtagatgataaagagcttataaggataatcaatgccagcgtgagcaggatattttcagatagaaaactcattgggggaagaagtttctgtcaggagtttccgtttatggcccggaattatttaaaggcatgcagagaaaagcaacaactggataatgagatttacaggacttgtgataggaatatcgccgttgattttgcacctgtaatgataggcggtgtttataaggggatggttattaccattcatgatattggacatttacagcagagagaagtacagatcagggcgaaattaaatgaaatggggctttatgcaaagtacgaattttttgatatcatctattcaagtcctgtgatgggacaggtaattgagcgtgcgaaaaaatttgcttccgttacctccaatgttctggtatacggtgaaacgggaacaggaaaagaactcatcgcccaaagtatacataatgcaagcaaacggaaaaccggtccctttgtagctgtcaactgttcatcctttccggagaatctgcttgaaagtgagctgtttggctatgaagaaggtgcttttaccggagcggtcaaggggggaaggcaggcctgtttgagcaggctcataatggtacactgtttttggatgaggtatcggaactgccggtcagttttcagggaaagcttcttcgagttctgcaggaaagggaagtgcggcgtataggaggcaaaaaagtagttaagattgatgtcagaattattgcggctaccaataaaagcctgaaaagactgaccatggaaggtctttttcggaaagatctgctgtaccggctggatgttttgaacctttctatcccacccttaagagaacgaaaagaagatatcgaattgctggcaaagcactatctgctgaagtacaaagaacagtttgaaacaagtgcggaccattttacggaagatgccatggcacttctttgtagttatccgtttatgggaaatatacgggagctgcgcaatattatggaacgtctcagcgttactgtggtggaggaaacggtgcactatacagatgtagaaaaatcattagggcctggcaatatggaggaacaggaagcagctcctgtatgcatcaatacggttcagaaggatgaaattgtaaggctgttaaaggagtgtggctataataaaagcgaggttgcaaggcgtcttggagtcaacaggacgaccttgtggagaaaaatgggaaagctgggattgatttagcccatatgttcacgtggggtgggcaacgttcagggcaacagaaaaagcaacacattaatgaaaaggagagaaggcttccagccattctctcttttttgttatttttggaaagtgttgaaaaaccaatgggttttaaagcatttatcgtaaaaataaaataaaatttaaaagttggaacaatgtttgcttattattagttatgtaacaacaaacagcaggtatatgtcagcgatgcagagtaatgtttaagaatcatcacatacagtccctatcgtattgatgtgaaagatgattaacagaatatctgcggaggagttgtatcctgcgtggtgggtgtaggaacgtattatgtaaatggaggtattactatgaaaaaattattggcaacggtaatggcaatggcagcggccctgtcgctggcagcgtgcggcggttccacggaacagactgggggagggatttccggtgaaacacagacctcacatacagaagattcaggaagtcggcagagctcaggagaaggtagtgtgatttcaatctggacatccaatgaactacataatcagatgtttgaattcggaaaaaatgcatacaacgaaaaacataaggacagccccatagagctgaagatagaggtctatcccaatgcagagatgtcaaataagctgctaattgctttgcaatctggcgtaggagcaccggatatagcagatatcaatatcaattatttttccaatttcctaaaaggtgatatccagctggtttccttaaatgacattgtagagaaggaaattggcaacggtgtacagtccaggtttgacctttataagaaagacagtgactactatggccttccaacccatgtaggagccactgttgtttattataacatggaaatcattgaaaaagcaggatttacgatcgaggatgtgaatgcggttgagacttgggatcaatacagggaaatgggtcttcagttgtttgaaaagacgggaatccccatgaccgttttcgaggtgtccaaccaacgcccgttctggcccatgattgtacagcagggaggcgactatctcaacacagacgggactgttgccatggacagtgattccaacattaaggttctcgaatggatgaaggatttttgggatacgggagcagttgttgctgcaccgggcggttctacatctgtggaagaattctggacttggcttaaccagggaggttgtgcatccttgattatgccgtcctggtatatgtcacgctttacaaattatatgccggacttaaagggcaagattgcaattcgtccaatgcctgtatttgaggaggggcagccaaggaccgtaggaattggaggaacgggaacagcaataacgtcacaatgcaagaacgttgagttagcaaaggaattactatatgaatcaaagctcacttataatgcgaatgtgaacatatgggaatgccttcagtttgaccctgtcaggaccgatgtatggaccgatgaaaagctgacggcgccaatggaatatttttataatgaatccttctttgagattatgggtaaatatgtggacggctgcccgtctcctgtaaacgcagatctttctgttgcagcccaggatcttgtaaacaattctgttatgtacaacgtatttgtggatgggtcacagactccggccgaggcactgaaagcagcggcggaagaattgagggcgcagcagtagctttctgattaaaatgatagggactgaggctgccgcatcaaggggctcctgcttcgggcggcagcttgcataaaatgtatggggaaatgccttcgatggcataaggaggtttaagcaaatatgaataaagacaaggagatcagggggctgcgaaaggttttatatagcaggaaagcagcaccatatatattctgcttaccatttattatttcgtttttggtttttttcctttatccgactgttaatacgttattgatgagctttcagaagatagaaggatttaataacgtaagatggatcgggctgggtaattataaacgtctgtttaacattcatttttacaatgctttaaagtccagtacgatctatatgatatgcatggtttccattatgctgattcttccgattacaattgctgcttttttaaattcgaaaatactgaagtttaaaaacttcttccggtctgccatatttgtgccaaccctaacatcagtaattgttgcaggcatcgccttccggctgatgtacggagaaacagaagccggtttgtttaactccattatcctgaaactggggggagggatcattgcatggaaaacaggttatgtcactggaatgataatgatggttacactggcggcctggcgtgaattagggatcaatatggtatactgtctgtctgcactgcagagcattccggaggaactttatgaggcggcaaacattgatggggccaatgcggttcagaagtttttttatgtgaccatccctcaggtgaagcccattattatttatatacttacgctgaccattctcaacggttatcggatgtttacagagggctatgtttattggaatgaaacaaatcctggcgatatcggcctgaccattgtccgctatatttaccagcaggcatttcagagaaatgactttggaatggggtctacgatcggtgtggtattgttggcaatcgtattgactgtaaacatgttccaattaaacttctttggtttgtttaaaaaggaggaagcataatgagagcgcatagaagaatgatgtccgtatttgtttttatattgttcttgctggtttccctgatcatgctgtttccggtatattatctgcttatcggttctttgcaggatggacaggagattttccgggcaggcatgaagttctttcttaagccggaggatataaagtggtcaaattatcccaacctttttacatataacaatggtatttatcccaaatggttcaaaaacagcgttttttatgctgcagcctttacggtatgtgccttgtcactgtcctcgctcgtaggatatggtttgggagcatacagctttaagggcagaaatttgatattcgtgcttgtcctggcagtcatgatgattcctctggagatattaatgctccctctttacaagctgattgtaaaaatcaggctgattaatacggccggaggcattatttttccctttatggtcgctccggtagccatattctttttccgacagtttgtatccggaatttcccaggaattcatggagtcagccaggattgacggttgcacggagtttggtatattcttccggatcatggtgccgctgatgaagccggcttacggtgcaatgactatacttcttgctatgcagaactggaacagctttgtctggcctctgattgttttgagggacagcggaaagtttacgttaacaataggaattgcatcgttaattaatccgtacagtgcgaattatgatgtcatgatagcgggttctgttactgcaatatttcccatcctgcttctgttcttattcaatcaaaggtttttcattgccggtcttacaagcggcggtgtaaaaggataaataaaaatcaatataattaaatctatttaggaggattgcaatatggcaaatcagattattgtcaatgcaaagacagaaaagtccactattaacaaaatgatttatggacatttcgcagaacacttgggaaggtgcatatatgatggcttttatgtgggagagaattcgaaaatccccaatgtaaagggaatgcggacagatattattgacgcattgaagaagattaaaatcccctgcttacgctggccgggggctgctttgccgatgaataccactggcgggacggcatcggcccgaaagaatcgaggccgtctatgattaatacccattggggcggggtggtggaaaacaatcattttgggacacatgaattctttgatttatgtgaaatgctggatacggaaccatacatatgcggcaatgtgggaagcggtacggtccgggaaatgtcagaatgggttgaatatatgacctttgacggacagtctccagtgactgaattaagaaagaaaaatggacgcgggaagccatggaaattaaaatattttggaatcggaaatgaaaattggggctgcggagggcgtatgagggctgaatattacgcagacgagttgacccgctacaacctatatgcccgggactacggagataataagctttatcgcatcggagcaggcccaagaggagcgaattataaatggactgaggtgatgatgagggatgcagccatgttcctggatgcgattgctcttcattattataccaggatcggagataaagtaataatcgaatatcttccggatggaaatgagcgttatttgagagatagttccaagtcccggatgtctgctacagatttcgatgagagccagtggttcggcattatgaaggcggccctgtttacagaggagcttgtgtcaaagcatattgcagttatggataaatatgatcccgcaaagaaagtcgcattaatcgtagacgagtggggaacgtggtttgacaatgaacccggaacgaatccaggtttcttatatcagcagaatacattgcgggatgcggtttctgccggaaccagccttaatatattcaataaccatgccgaccgcatccatatgacgaatattgcccagacagtaaacgtacttcaggcaatggtgcttacggaagggaataagctgatccttaccccgacctaccatgtttatgatctgtataaagttcaccaggatgcgaagctgcttgattttgccattctttcagatgactatgagtgcggcggagagctgctaaagcagattaatggctccatttccaaggatggcaagggaaatatcaatgcaaccctggtaaatattgatcccggtcatgctgctgaggtgacatgccatatagctgactttggaatgattgatgtgatagagggaaccgtgcttacggcagatactatgaatatcatgaatacatttgagcagcctgaccagatccgtcccaagaaatttactgactttgtgattgaaggcagtaccatccatattaagatgccgccaaaatcagttgttctggtttcggttaaaaaataaaggaggagcttcgttggaagtgttgcgcgggaactgtttctcctgtttgccaaaaggcctgtcagatgaagaatatgagaagattttgaagcaatatattgaatgtatggatgaggagataaggactcctggagatatctatgagaaacggctgctcctttgcgggcaatgtgaatttctgagaaatggcatctgcaggctatgcggttgttttgtggcattgcgggcagcaaagaagtttcattattgtgcggatactcctgccagatggtagacattgtatggaagtttagccatcttggcagtaagtgctgaaggcctggcttcttgatttaccaatgtggaagtctgaataaaggttcattccgtactcatgcatgctgagaccgtctggctgctcctgattcgaaccctttaaactgatggtcttcttcataaggggagagatgataaatgccgttaccgccgcatagaccggaacagatataacaccgtttatttgggtgaaaaattatagctttctggttatttataagccagatttatgggtatgtctagaaccggcaggaaaatctgccggttctagacgttctgaattgttttatttcgggatccatctttcacacacgatattcaactattgtttattttgccctggctttggattgatattgttcattattgtttctttggtgattcagctttccataggtagaattcaggctctctatggtattgtctatatatatgaccatattcgaatttgagaaagtcagaaagtcctcatcctttagaagaggcatgaactggaagctttcagaactgcatttcaaatgctgtcttgcattttactccaggataagataagataaaaataatttgtaaaaaactatgatgcaaaatgaaaggagtaaaaaaatatggccagtattcgagatgttgcgttaaaggctggagttggaatagggacggtttccagggctttgaatggaactggttatatagcggaagagaccaagaaaaagatccttgatgcggtaaaggaactggagtatgtgccaaatgaattggctcagaatctgtaccgcaagcgctccggttttgtaggggtcatggttccggacttggaacatcctttttttgcaggcttgacaaaacacatagagattgaactgtataaacatggctataaatgcatgatctgcggtgttgataagaaattcttaaaacaggaagagtacttggagatgctgcaaagaaatgttatggatgggctgatcagctgtgtagatatggctgttgatacagatataagtaatatacggcgtccgattgtatgtatggatagaagctgggggcctgatgttgccaatattcattctgaccatcgccagggaggccggatggcggcggaagtcttattaaaaggaggctgccggaaggtggtgcagttcatgcccatgccatacgacaattggttttttttagaaaggcataaagcatttcgggagagaatggaggaggaagggcataaagtgctggaggtatatactcccagagatcgtatgatttttgaatacagtgaatgggtgaggcgggaatgcgttaggttcattgaatatgcggatgggatttttgcagatgatattgcagcaatcacctgtttgaaggtagccggagaatatcagattgatgtacccgggaggcttaaaatcgtagggtatgacgggatccctctcaccagaatgttacatccaaccatagcaaccatatgccagaaccttccggaaatagccaagaggtgcgtaaataccattatgcaggaaattgaaggcgccaagcaaatagagctggaccagattgtgaaaataagcttccaggaaggtggaactgtttaagaagaccgggaacataaaattgaaagtatggcggtgctttacataatacagtataccgttattatatagtgaagccgcctcatgaagaagtcgtgatatttcttcatgaggcggcttttgttttgggatttttctgcctgcctataactgaatgctttggaatgaagggtctgcagataaaggatattttggcaggggtatttcaataataacggataaaatgttgatcgaaagctttgggtttatgcatttgctgggtatatttaagagtttggtatgcagaaaggcctctttttcagcaggtcccttattgcactggatcatttgtcaaagttatcaacaggcccttgaatttgcataggttattggtcctgtgaacaaatgtctttttttataaaatattagccttcaaacccaataaacacgttgataaattcaatcaaaaccaagcttcccaacagactctttattatacgcgcccaatatgtccgtgatatgtaagcctcactgttaaaatatattctttcatagaaatgagaactataatatcatgctcaaattaaaaaatagatgatgcagatgctgaatggatatggaacagatgtggaacgaggctgtaaagctggaataagaagccggaaaaagaagaggaaatatgaagcagggttatgaagcagaaatataaagaagaaatataaagtagaaatataaaacaggtttatgaaagtgatttttttaacagggataggaaccaagaataaagaacaaaaatatggaacggaaatatggaacattgacgcggaacaagaaaatagatcaatgtggtgaaacaaaaatataaaacagataaagtaatacaaggaaaatcaaactcttaaacatgccgctttgttggctgaagtgcataataaaggtagattaaaattggtattaatacataaaattaatttttgtttcacatgtatattgatatattgtacaaattaaactataatacaaaatgtggaacgggtttcacataaagaatattacaaaagttatcctatataggggatatgtgcagacttcttaggggaaaggaaaccgctatccattcatagttccgtaaaaggaaaggaggagaagttaagtatgagtaaaaatcgtaaagaaacaaaagtcatgctgaaaagcaagagggatttgaaagggaacctgcggagagcgttggcctgctggcagctatatgtgcttttgatccccgctgtgatctggctcttagtgtttgcttactatcccatgtatgggttgattatcgcctttaaggattttaagccaaggatgggaatcatcaacagtccctgggcggtgccgttgtttaaacacttacagacgtttttcagtaccagcattgccatgaccgcgattaagaatacggttgttatcagtttgttaagcctggtgatcgcatttccaatccctattgtctttgctcttttgctgaatcagatcacccaaaatggagcaagaaaggcaattcagacgatctcttatgcaccctactttatgtctaacgtcgttgtggtaagcattattaccgttctgttctcagcgaatggtctggtaaacaacttaatcagaggggcagggggtcaggaaattctgtttaccagttctgccgattggttccggactttgttcatcggatcaaacatctggcagaccatgggatttaatgccatcatatatattgcggcattgatagggatcagtcctgattactatgaagcggcaattattgacggggcatctaaatttcagagagtattgtacatagatatccctctgattctgccaacgattattttgatgctgattttgacggtaggaaatattatgaacgtaggttatgagaaggccttcctgatgcagaacggaaccaatacggtggtgagcgagttgatttctacctacgtgtacaaggtcggtttgaaaagtgcacaatacagttttgctactgcagttggattgtttaatgcgctggtgaattttgttatcctgctgattgcaaactttgtttccaagaaaaccagtgatatcagcatcttctaaagttaagggggaataaggatgaatccaaaaaagaaaaagatgaagttatcagcaggcgacagaatttttgtggcagtgaatgtgtccgtaatgctgctggtatgtatcgcaattgtgtaccctctttactatgtggtcctggcttcctttactgatccggtcattgtaaactccggcaagctgctcttgtttccggaatccctgtatttggacggatacaggaaaacattgagctatgcgcccatctggagcggatattggaacacgatcaagtacacggtggttggcaccgttgtatccctcgtttccaccattcctgcaggatatgccctatccagaaaggacctggtaggaaacagggtgctgatgtttctgtttacgtttaccatgttcttcagcggcggtatcattcctttgtatctgaccatttcccagctgaaaatttacaataccatctgggcaatggtgcttccggtggcggtatcagcctacaacttaattgtatgccgttcattctttgaaagcggaattcccatggagcttttggaggcggcaaagctggatggatgcagcgatttcgggttctttttcaggatcgcccttcctctatccaagaccatcatcgcggttatcacactgttttatgcaacggccatgtggaatcagttctttaatgcgctgatgttcctgggagatgaaaataaaatgcctttgcaggtcgtattaaggaatctggtgctgatgaatcaggctggaaatgtaggagcttctgcggcggagctggtggcaaagcagaagcttgcagagcagttaaagtattgtattgttgtggtttcagctttcccattgctggctgtatacccattcctgcagaagtattttgcaaagggtgtcaccattggtgcggtaaagggctgatggagcaaggtataaaagaaaaataaatattattttaagaggaggaataaatatgaaaagaaaattagcagcaggcattctttctgtatcaattgcagcatctctgctttccgggtgcggcggctccaaaggcagcagcaatacagccgatgcggaaaagggagcagtagagctgacggcagaggaacaggaagccgtagatgcgggcatcatccaattggatggctctcttccgattatcaaagatccagccaagtttgaagaaaagtacggaaagatcaaagtattaaacgttggtgatgctcagcgtgtgacaaaacctgaagatattgaaatggtgaagaaatggacggaagatacgggtgtatcctttgagtggaccaccatcccgccggaaaatgcaggagaaaagatcaatttaatgctgacggccggcaatgagcttcctgatgtgttctggaattttgagggttcccagtccggcattacggttgcccagtatgcggatcagaacattttcctcccaacagaaacaatcgtaaaggattacatgcccaacttaaagaagatcctggatgataacccatcttacatgatggaagtacagagcccggacggtcatatgtatggcttcccctggattgagcagatgaaaggcttaatcctgactcccgggcccttcctgattaacaaaacctggcttgacaaggttgggaaggatgttcctgcaaccgtggatgaatgggtcgattgtctgaaagcgttccgtgatgccggtgatttaaacggaaacggcaaagatgatgagattcccatggcctgctggtttggtcagcataaccaggatggtttcggctcttataacctgttctacagatttaccggagctttcggaaatgcggattcttactgcggcggcaatccatatgccgaccatttgagaattattgacggtaaagtgacctttaccgcattggatgaatccattaagaaaacagcagaattctttaacatgctttacaaagaaggactgttatggaacggttcctttgaaaatgcggaaagcgctgcatttaagagctctttgatcaaagaagatgtagctagaatcggctctttcggtgtttgggcagatcaggaaatcgtaaacctggatgtgcatgatgaatacgttcctcttccgagattagagggggaagcaggaaagaccggctttgccctgaaccagtcagagatgcaggattcttctattggtgcgattacaacagactgtaagttccctcacctggtagccagattctatgactatatctatggcaatccggaggtttctatccagaccaactggggcgcaatgggatacaactatgtgaaaaatgaccagggtatcatggaaacgcctttagatgaaaatggacatatcattacacaggatccgtggacagattttggacagcagagagccaatacaaccattacccgtacgccaatggctgtattagacggttattatgacaccgttgtaaaatatacctttgatgcggtaaagctttatgagtatcaggtggtcaacggcaaagaggatattctgaaggaatatgagacaattccaaaagtaatgatgacaactgacgagatcacaagacttgcacaggttcagcctacagtttccaatattgttgaccgttacatagcaaaatggattacagaaggtgtggatgatgcaggctggacaagctacaagaacgaactggaatcagcaggagtaaaagatattgttgatatttatcagggagctgtagacagagcgaaaaacgctgtaaaataataaaaaattaacagggctgccacacagaataggctgtacggcagcctctgctatattgctaggaggattaaatatgagtacaaggggtgtacgtaatttcaggccaaaggtacattttacaccgccaagaaactggagcaatgatcctaatggaatggtctatatggatggtctgtggcatctttattatcagcatcatccggaacaaccggtctgggggccgatgcattggggccatgctgccagcagggatctgctgcactgggagcatcattccatcgccttgcatccggatgaactgggttatattttttcgggaagtatggcttatgataaagagaatacatcaggctttggaaaagctggagagattcctgtagtcgccatgtataccagccatcgaccggaaggcggccatgaatgtcaaagcattgcttacagcgtggatggaggataccattttgagaagtattacggcaatcctgtcattgataatccaggcctggaagatttcagggatcccaaggtgttctggaacaagaagcggaattgctggagcatgatcctggcggccaaagactgtgcttatatttatgcatctgaggacttgaaaagctgggaaaggacaggcgaattcggcagggaagagaatctggtgaatagcacctgggaatgcacggacttgttccctcttcagacagaagagggtgaaaaatgggtgctgcttgccagcatgatggcaattccgggaaggtgctgcgccaatattcaatattttattggagagtttgacggagatacattccggaccggaacacaggggaaggaaccgctttggctggattttggatttgacaattatgccggggtgacgtttcataattacgacaaatccatttatttaggctggggagtcagtccggaatacgccaatctggtgcctacgggagaatttgcagggttgatgactgcagccagagagctttccctgataaaaacagaaaaggggcaccgcctggcagctaagccttttggattggatcatttgcgtgctgtttcttacccggttgctgacggggattcgctgattggcgaatgctttggattgaaagtgcaggggcgatccggtaaaataacattttcgaatgaaaagaagcaggagctggtaattgagatagaagaagagaacatcagaattgaccggtccagggcaggtgcctgtgatttttcagaaaaatattgtgataagcttcattctgtggcggaagcaaaacgccttttgagcggagcggttgatatggaaatactgtttgatgtatcttatctggaggtatttgcagacaagggattggaaacggcatctatgaccgtatacccggatgttccctatgagaaaatctctgtacaaggggatttgactgtgcagatttaccagcttcagtaataattaagaaaataaaatgtagactggaaagaggaggaatattatgagcacaaaaggaataagagattttcggcccaggattcattttgctccaaccgataactggatgaatgatcctaacggtatggtgtatataaacgggacttaccatttttgctaccagaaataccccggtgataccgtatggggccaatgcactgggggcatgcggtgacaaaggatctgctgcattgggagcatcttcctatagcgctgtatcctgatgaactgggttatatattttcaggcagcagtgtttatgataagtataatacctcaggctacggaaccaaggaaagtcctcctatcattgccgtttataccagccatgacagtgagacagggctggaacagcaaagcattgcttacagcgtagatgggggaagcattttgagaaatcttatttgaatccggtgattgaaaatcccggcattcctgatttcagggatcccaaggctttctggaatcctgtccatcgctgctggagtctggtgctggcagcccaggaccgggtttatttttacagttctcagaatttgaaaaaatgggaaaaaacaggagaattcggtcctgaaggcaaccgtgtgaaaggtgtatgggagtgcccggatctgtttcgaatcaagtatgaggatcaagtattctggattttagtggtgagcatgaccaagacggacgaggaacgctgcagaatccagtattttataggagacttcgacggagacaagttcatctgcacccatccggcagatgaggtactttggctggatgacggttttgacaattatgcgggcgtcacgttccagaattatgattctcccctgcttatgggatgggccatgaattggacttatgcatccaaggtccctaccaatgaattctgcggacaggcgactctggcgagaagcctgtctgttcgtgaaacaaaggcaggctaccggctggccggacatgcggaaggtcttgacaagttccggcatatggcgtatcccgttaaaagcggtgtacatttgatgacggaaacctttggtttaaaagtcaagggggaaggggagggaaggatctacctgtcaaacagtgaaggacagaggctggagattgaagtgacggaagatacgataactgtgaaccggaccattgccggataccgggagttcgatgaacagtttatgacgtcggaatattccgtagcttccgcaaaacgcctgaaagaaggaagctgggaccttgaagtgatctttgatgtatcagttttagaagtatttgcagacggaggtcttaatatgatcaccatggttgtatttcctgacaccccttatgatacgatcaaatggaaaggcagccttgaggtatctttgtttgaaattaactgacaggggagaattgatattgatagaaatgtaacaatcttggagggatggtgaaatatataagtggtgagaggactttttttgaaagtttaaaaagatgcggcatataattccaaatatagaaattgatcaaaaacataatactttaaaagcccggtctcagctccaggttccaaaacataaatattttcaaccaaacttatagctacaagcgttccgtggagctataagtttgcaaaaaataattacataatggaatctgaaacgggaaccgtctgctgttgcctgataaatgatttattaactggaaaatcagagcaacagcagatttttttgttaagcacctcattattactttgtgatatgggacatacgtcctgatccagcctatctgaaatactgaggaaactgctttacgattccaagggccatgatatcggccatttccagtgccccccgctcaatatcggtaaatgtacctatgctgtcctcaaaatttccggataacatgttgcagatgtcctctttcagaagcgcaagatggtcgtgaagcatgtttttccattcttcggctgaccaatttggattaatgtttccaagaaaagccgcaatctgatcggcattctggtataatcgtctttcaacatcatccgctgcggccgtatcttctgcttttacagctgtgacgtattcattggcaagagaaaggtgttcgttaagcagatttgcaaaattctcagctacttcctctccatagaaagtctgtaaagctatttcaaaatcttttggattctgtgcgagacgattggcaactgactgcgcatctgaaaggtcctgtatcatactttgcattgccattctggcccagtaaacatgctgagcccacaaaagacgaatgtagttgtttaaattctgctcttccttgctgacccagaggaaaataggtggttctgtcggttcaggtataggttgaggcgttggccgtggtgttggccgcggagttggctggggtgtcggctgtggcacaggcattggctgaggatgttattgcgtctcctgggtatacagatcaccagtccgacaaacagattggcaggatcgatgcctgggttaactgccatgatttcatcgaccgtagtctgaaaacgctgagaaagcagccaaatcgtatcaccggcttcaaccacataggaatcggattcctccgggcatacggtggtctcattactgctggctggttccgtcggtgtgacggcctgggaacggaaccagaaaggcaggttgggcagctggtatccggccggtatccagatcgtctgacctactctcaggttgctgggattcattccggggttcagggccagaatactttctacggtggtgcaataacgctgggaaagaagccataaggtatcatttcgctgaatggtataggtacgaaggcctacgggacagcggctcccaccgccgcctgttcctccggaaggtggagtcggaacgggaggacggggagctcttcttgccggaatacaaatggtctgccccactgataagttgtttggatttaagcctgggtttgctgccataattgcaccagtggaagtataataacgttgtgaaatctgccatagcgtatcgccggatcgaatggtataaggaaacagtcctacagggcaagaagccataattttactgcctttcaataaaacaatttgccttatgttatgttaaaaaaatgggaaagtacctgtcagccttgacctttttttattttgttaagaagacgggctttgcatgccaggaaactggcccgctctttttgaaatttatgaaaaagatagtaatatttatttgcttgtacgattatgatagtaccagcactttaaatcaaaatagcccatactccatctcctgttatacagtcataatcctgttaacaggcagatggccgttggcagtcagggggatatatgatattaacagacgatttaataaatagaggtttttccttgcatgatgtaaatgaaaatgacttagaaagatacataaatataagaagggcctgttataaaaaatatgtagataaatacaatgatggctggattgaagatatacaagttataataggcacagataattttcataaaatgcaaaaatgtacttgttttcagaaggtactgctgaacaataggattgtcggttttttcacatttaatgaacaggcggacaggtttggttcaatatcccttcagcttataaagtctgcccggtataagggaatagaggcattttatttacgccatattacgtcactttccagggaagcagacaagccgatattcttgaatctttacaagtctgacccggttcaaaatctatataagcaattcggatttataatttatgaccaatcaagaacccaccatttaatgagttttaatcaaaatggtgcaatcgaaataaacaatacaaatcatatcagaaattatatgaaccgcatgtgcaataattaattagagaatggagtgaaccaaaagcaaaacgccggtagcagaagaatacgcataaagaattgccagccttataatcagaacacagattaaaaggctggcaattatcttattattttggtcctttctctgcaaccgcggatgcagctatggcagcagaaggacccatcattttaaatcctcttcagcaaaagcaaatacgggaaactcccctgtttaaatgacggatttaacggggagacacctctggcgggatggcgctttcaaaaggcttgccgccaagatttctctcatgctcctcttttgctttcttaatgatctcaggattttccaggagatcgagagcggtcattgcaatggtctttccggcagtgatcattcccttatgggcaatgcttgatttgccggtggcaacccactgccaggaatgggctggggttccgtttggcgcagtcgtaacaactgcagtgaccgtaggaatggtccagctcacatcacccacatccgtggagccgctcatgggcttattggggaatgtgaggggagcaaccagacggttaacagggcttttggcttcctcttcaataactgacttctctgcgtccggaaggaaggcctggatctttcttgcaatctggttcttggttgactcgggaagctggtcatagaactgctttgcataggccatttcttccggggtgtattcaatggggctcacctgttttaagttgtcatacatgaccctgcccagctcccggttgaccagatagcttgcacaggcggagtcaaaatccacttccagttctgtttccgtcatcaatgctgcgccctgggcgattttgaccacacggtcgtaaatttcctttgcctggtctgttctgggggcgcgcacaaaatagtaaagctctgccgtaggctgtaccacattggctgaggttccccctacatcggtaaaggcgtaatgaacccgtccctcatcaatgatgtgctctcttaagaagttcacgccgatgttcattaattccgctgcatccaatgcgcttcgcccatgttccggcgccgcagcggcatgggccgcacgtcccttaaaccggaagtatgtctggaatactgccagggagctgaaatcccaaaggcctgtggaatccatgggatgccaggtaagggcaacatctgtgtcgttaaaaatgccgtcccttgccataaatgccttcccatagccgctttcctctgcagggcagccaaacaggcggatggtgccggataaacctgcttccaccatgtaatccttaatgcctaccgcgcctgcggcggctccggcacctaacaggtggtggccgcagccatggccgctttctcctgccttaatggggcatggagacgcaacatcggattcctggctcatattagccagagcatcgtattcggcgagaattccgatcacagggcttccctggccatattcggcaataaaggcatccttcattcctgccaggtccctggtgattttaaagccttccttttccattgcactgcataataaatcggcagatttttttaaagcaaagcgggtctccgcaaatccccacacctgatcggagagggccgtaaataaatcccttttttgttcaattaattcaataatacgctctttgccgctcataacgagtctcccttccttgttttcatcttatttgtttttcgcgtttgtaattaaaatagatgcacccactgaaagaatcattgtcactagaagcagatatccctggacctggccgtattttgcggcaaacaagactcctgataaggtgctgatgatgagaggagtgatggccaaaggaaagttcttgcgtaaatagggcagcagcatggttccgagaagtgccggcataacgctgctgaagcctggctttaagacggggttctctaagtagtgaataaaaggagtaaataagaacatgcccgcaaatatgatcagggtggtggtaatggaggacatgccgatggcaagcacggaaaccacttctccttcatcgctgtgaggctccacattcataaggcggtggcctgcggcagcagcaggaagcttcatgttcataacattaccggtaataaaagaaagataagtaccgccggctcccagaatgggtgaaaaggagatgacctctgtaagctgggtgggaataaatacgatacaaagctggatggcggcagccacaacggttgcggtattgagttttacatcataaataattgtcgcagcaacaggcaccataaacatgagcgcaatgccgatcagggtagaccagcgtcctaaccggtgaatggaactgtaataatcgttctgtttcatttgttttctcctcctttaccctaatatctgactgaatataattgcagaggtcatgcccagcacaaggctgatagggaaacaaaactccgacagggccttgatattgctttttttagcagcaacgtccagaagccagctgattgccatggaggcgattaccaccagcagcggaacaaggccgatgggacctgtgattcctacccggaaaggagtggctaaatatggtcctgaaaatacacatagcagtgcaaggaacatggaagcaaaaattgcctgaaaacgtttttcctgttttccctttagcaccttgatccctttttggatcagcttggagccaaaggcggtgtacagcggtccccagatgatgccgatggtcatgacccacatggcgctgacgaaaacctcaagggaaaaccggttgtcggcaatgccttccaggccaaaggcctttgcagtaacgtctgccgccatattttcatatactcctgatccgaccacgctgagacgcagccatgggaaatagcgtccaagggaaggcattaacagcagcaggatgatcaggataggcaggcttggcagaacagataccacgcagctgttgatcatgacctttttcatggcgcttttttccatacccagttccaggcctcttgcccaggcctttcgcatgaatatgacggcttgtgccagcacatatgcgatgacaatgccgcagagcaggaataccacaccgccgtttgcgatgtctaaataattgttcataaaagacctcctctttcctttttcgggtgacctcacccttgataagtaaattttatataaaaaaatataaaaaataaataaataattgtatataatgtaggaggtttcaatctttttttaagcttagaataagaatggaataaaaatgggaggtcattttttaaccaatcaagtagcgaagcggattgcgaatatccccttgactatttttactgtttttttatgacgtaaagcaccagcccgttaaacgtaaggctcgcatgcagagagcattccccatcgattttctgttccaggaaatagaagtccggttgtacgacacgttccaggtactctgtaacatcaggatcattaagatccggcagcccggctcctgaccagcggttgaatatgcctgcgcttccctggtcaaatataaaccgtttgatccggtaggagccgggggccagtccctgaaggcttaaggttatctgatggatctcatgttcaattaaaaacagatccactgagtaaagagggttcatgtaatagggactgtatatgacaatatgaaattcgtcctctccttttttagtaactacaaggttgttattgtaaaataccagcctgccgcttacataattaaaggcctccagcacaaagtaaaccgggcgtttgatctttttaagaagaaacaggcccagtataccgaaatcatggattccttcaaactcctggatatggtaagtgctgaccgggaatccgatggcttccactttgccgcataatttcatcatggtgtcaaagatcagggcggatcggaagaatgccccggcttctgccacgctggagcctgcaagcgtattccaccgggtcatatacaagggcggaacaggcagatcatgggcttttaaggacatttcaatggcttcgatccggcatacgtagaaatcctccaattgctgttttgttctggagtggtcctgctcaggaaacgggtggggatatccgtgaaatcccgcaaaacagggaggggaaataaggttttttaaggcctcataaaaagcctcatgctcttttcccggcattaaggcccagtcagggatcaggattccaatctgaatcttaagctcttcctgcattaagagcttccaaatggaattataaaattcggcaaagctttttaagtgggcagggtccttacatgcgatctcaagtctccagtgccccagtgtctgacagctggtattagagcgcagtatgcctgccaaacaggacagacgcttcatataaacgcttaaatcgctatggcagcgatccaattgccgggacagatcgatctgtacgtaaggggtgagcttaagttctcctatctgatgtatgcactgattgtaaagataattggaataaaaatggtcattttctaccctgatctcatctaaatcaaaggcttcaaaataaatataatcaaaggacagccttcccagctccctgagctgttccatgagctcgtcctgaagaatgtctgtcatgcggccgatctggaccattttttttggccttttcagctggatcggggatatctgggtcatgtccagcttgatggcatccggggaatacagggccgtgtcgtgatgcatgtcatgccttttcatatatttgaccagctccaaaaggttatcctgtaaatccgagctgatttcttccagactgctgttcttcctttttgtgggccttgcatatattttccggtattcacccggagactttccatactgcctctggaaagcggctgaaaaggctttggcattggcaaatccatggtcaagggcaatcctgataatcggctggctggtgccaagcaggcttacgacggcatgttccaggcgtacctgatttaaatactgcaaaaagcttgttcccattttgcttttaaaatatttggaaaaatattgggggaaaggtacagctgtttggctgtatcagtcagggtgatggcagaagcatagttgcgatgaatatagtctactatatggttgagagatgccgtattttgcctttgtttttcatagggggattgtttccgactttaaagcgctgcataagggtgactaaaaagcggaacaaaagggcccggaattccagatcagatccttcttcctttttcatatgtacaaggagcatacgggtgagcagacgcttaatttcatataacttgtccgaatctgactgcaggatggaattacattgaaaggtgctgtttaatacttcttcgcattcgttctttaagaaatcctcttctatgagcagcataatggccagattattatactgggcagagtaggaatggatatccctgcagttgatcagtacaatatcatccggagacatgtgatagacatcaccgttgatctccacttgtaatttccctttaagcagcagcacgcactccaggcagctgtgagtgtggggaaggatgtttttaatgctgttaagcgtgatccctactgacgtttgattcataaacaggctcctttcacctaataattcttgtttttattatagcttatttttatatgccgggaaagcagaatccggatgagaatgcgccagaaaaggcctcaaaaaccagtatcaacgggtttttgaggcctttgcatcgcaagagctaaaaaatgacaggctgaatttgcttcccttctaaagcgtattccaaagtatctgcaatcaggtcggtatgtgcgatcatggaattgggctttttcacagggtcatcctggccaaaggggacgaaataaatatattttgcgttaaataattctcccacattcttaaaattaattccaagggcatcgttggtggaaagagagatcaccagtggcttggaatttcttaaatgggctttggctgccatgagcaccggggtatcggtgatgccgttggccagctttgccagggtattgccggtacatggggcgatgagcaggatatccagatagccttttggcccgataggctccgcttcctcaaggctcaggatcggctgattgcctgtcatggcagagacctgcttcatgtattcccctgtatctccgaaacgggaatctgttgtctgtactttggtggagaaaatgggatagatatcggctcccttatccaccagaacctttatttccttttctattttatcaaaagtacaaaaggacccggtgattgccaggcctacttttattccttccagcttcataggacactcctttacgacaggtattttacaattgcttcaaataaaatctccgctgaacttccgggtgcatagatcccgggcagtcccgggcaaagcttggcgcggatattctgctgcctgcagaaatcaaaatcaacgccgccgggggcggatgcgatatcaatgattgttacgtccgggtccatggaattgatcaaatctttttccaggatgagagcggggatggtattaaaaataaactgataatcccccaatcccagggccagatcacttaaaggtctggtatgaagtcccatggagtccgcggcggcaagctgtgtttccttacggcctgcaacggtcaccaccgcatccaggccctttaatttcattgccagagtttttgcacaccggccaaagccggttaccagacaccggcttttgtgaaggcagccgggacttaggcggatggcctcagcaatggcgccttctgcagttgcaatggtatttttcacagtaacatcttccatgtccatatagtcaaaacatgcaatgtggttttcttcggcatattcctttacataggcagggatgctgcccccaaaaagaatgtggtcaggtgtcaaaagacttaaaaggttccctatccctaagtcttccatgccgttgacagaaaacaggctgattttgtcccttgtaaaggggatgggacaaaggatgacattgttgttttttatggcttcctccatggaaaatgaaggatcctcgctgctatagtgaaaggtcgtctgaaagccgtttttaatcaacatgtggtttaaataaagctgccttgaatcgccgcctaaaagaagaaaattatgcatacggtcatcactccttataatggtttatatgataaaaaaattgatttgtgtatggtaccaacaggggatgtttgtcatacttttgttagtatgaacctctaattttgggaatgagtgcctatgaaagatgcgatttttaaaggctctgcggtagccatcgttacgcccatggatgagcatgggaatttagattttaaagcaatggaaagattgctgaaatttcagctggaaaacggcacggatgccattgtagtcaacgggaccacaggggaatccgccaccctggaagaaaaggaaaaactggaactgatcgaatttgtggtgcattatgtaaatcaccgcgttcctgtgatcatgggaacgggggaaactgtacgtcccacgccgtgcgtttgtcccgaaaggcccagtccttaggagcgtccgcattgttacaggtgaccccctactataacaagacctcccagcatggcctggtggagcattttacagctgtggcagacagcgtggatatccccatcatcctttataacgtccccacccgcaccggggtgaacattaatccggaaacttatctaaagctttcggagcatcccaatattaaagccattaaggaagccggagggaatatttcccatattgccaaaactgcggctctctgcggcgataagcttgatctttattcgggaaatgatgaccagaccgtccccattcttgcccttgggggtaagggagtgatctctgttttagccaatatcatgccctttgagatgcatatgatatgccagtatttttttgaaggcgaattggaaaaaagcaggaatatgcagctggagctgattagcattatgaacgccatgtttatggatgtgaatcctgtgccggttaaggcggccttatccatgcttgagctgtgcgaagaaacctacaggctccctctgacccgtatgcaggataaggataaagagatcttaaaacaggtcatgaaaacctgtttccctcacttataggatcgcactctgcagctgttttaaattaattatcattttggttgcgaaccttccaacgccatgctatattaattgtaaccaaaacaaaggaggacggatgtctatgaagcacaaaagaaaaacacacatttttacgaagttgctgttcggtatctccattccagttgtatttatttttattctgtcaggagtattcatttcaacgcagacaggtaagagcatgcaggcccagtcaattgaaacactgaattctgcttcccttgcggctgcaaatcaggtgaattctttcctgactttttatttggctgaggtgcagagtgcggctgccagcagccagtttgaaacgtttcttaccaatgccaccgggaaggtaaggctgccaaacagtgaaggttatccggatgtaaagaagacacttgataagctccaggctactgacaaggaaaatattcttgccgcatggatcgcggatctggatgtcagccaggtgacgcagtcggataattttacgtcagaagacggctgggatatttccacaaggccctggtaccgggctatggaactggatcaccccattctgacagagccttatgtggacgcaagtactggacaggtcattgtcagtgctgtctgtggagtgtttgatgataaaacaggggaaccgctgggtgtggcgggagttgatattcaattatcccagctggtctcggttttaggcgattataagatcgggaagaccggagccgtgattttggcaacagaaggcgggcagatcgtctatcaccccaacaatggcctgattcagaagaccatttcagagatcgatatttcccagaatattaaagatgcatttaccggtcaggcggtgggaaattacgaatataccatggaaaaggttccgtatatgggttccatcaaccgggtagggattcaggctggcttgtattgtccagcatccaccagtctgaggtgctctcctccagaaaggcggtggtgagcactataaccactatctttactctgggttcctttattcttattctgatcatctttgtaatggccaggggatatccggacctcttagaaagctgtccgtcattgcggaacggattgcagagggagaacttgatcttcaagtggatgtatccagcagcgatgagatcggcatggtggcatcgtccctgggaaatacggtaagccagctaaagaattatgtgaattacatagatgaaatcgccgcagtattaaaccaggtagcggaaaaagatcttgttttccagctccagtatgattataaaggtgactttgagaaaattaaaaagtctctgctaaagataagaagcacccttaccaccactatggagcgtattaccgagacttctgatcaggtggcatacggcgcacagagcatttcggccagttcccaggccctggcacaggggcaacagaacaggccagctccgtggaagagctggcggcaaccatcggtgatatttctcataagatccagcagaatgcaaaggattccacaagtgccaaccagcaggccgctcttgcttccagggagctggaaaccagcaatcatcacatgaatgagctggtttccgctatggcagagattaatgaaagctccagtgagatcgggaagatcattaaggccattgaagacattgccttccagaccaacatcctggccttaaacgcggcggtggaagctgcccgggcgggagaagcaggaaagggctttgcagtggttgccgatgaggtaaggaatctggcctcaaagagctctgatgcagccaagagcaccactcatctgattgaagggtccattcaggctgtggcaaatggttccaggcttgtggatgaagcggctgaatcactgagcaatgctgtaaacagtacacgttctgtttctgaaatgataggaagagtatcagaggcttcggttcagcagtctgaggcaatccggcaggtttctgttggaattgatcagatatccggcgtggttcagactaattcggccacagcggaggaaagtgctgcagccagcgaagagctatccgatcaggcagagatgttaaaggatttagtaaatggatttaaatttcattaatgaatcataaataaaaaagatgtccggtaaggaattggcttatcggacatcttttttatttgaatgtattggtcatgctgatttctcatcaaggagaaagccggacagagaatccagaatctctttgtggtcgttttcatggataataagctccagatcagtgtcagggcaaatggtcagaatgccgagaaaagattttgcgtcaatgacagtgcttcctttacatatatccatgtcgcagtcatactggttgactgtcttgacgaatgcggttacttcgtctatgctgtttaagcagatggggtaccttttcatatagctcacctcattaaaaagatggttgtattcggataaaatccaagctgattatatgacaacatggaaggaataagctatgtctaaatttgtataaaaaccgtcttttcttgcaaataatgaggagatagtgctataatggtctggggaaggcaggggaatctgccgtttggagggaagcatgaaaaaagaacttctggaatatttaagggatttatcggaagggaagaatggtttatggaatgaagcggcttccgccctgtgtcactgtgtaaaagaaccgggaaacagtacggctgataaggatattgccatgggccagggaaagctgatggacatgtgctgccagcctcacaggcttcccattccggatcacagccacaattatgtggagctggtttatatgtgcagcgggtctacggtccatgtgatcaacggaaccaggatcctgcgtttggaaaccaatgatcttttgctgttaaagcaggggacgattcatgccgcctatccggcggatgaggggctgttgcggtccatttctttttgatgccggaattttttttccatcccgagctgatggtagaggatggaagcattttgcgccattttattaccggtccggccatgggaaagcattgtacagcagaataccttcactttcatttacaggacatgctgccggcccagaacttattggaaaatatgatctggtccatgatcggagataaaaagggcaggcaggaaattaatcaggctaccatgggaatacttattatggagctgtttcataatgcggataagacagaattgcatgatatggctcaatatgaggaaaaaattgcaataactgcatatcaatatttagagaacaattatccgaccgcgaccctggaagagttttcgactctgtccatgcagccgtcttattatatcagccgcttgtttaaacggcattttcaggtgacgtttacggagtgtctgcagcttatccggatgatccgggcggcaaattttctcgcctctacggcaaagccggtggaagaaatcattgcagagatcggctatgaaaacagcagctattttcacaggctgtttaaggagcggtatggaatgacgcccaagcagtacagggataaatctaaggagtaattctgaaaagattatgaaatatttcccaggaagattgactttcggtccacaggttattatagttaaggcaaaatgaagaagggacggcagacacgggatgaatgggtttagggaacgttttgctcgttttatgatcggaagatacggcatggacaggctgggacagtttttaaacggtgcagcttttgtttttattgcggccggatttttcagccggaacaggcttctggacacggcagggatgatcctcctgattttgtgctatttccgcatgttttcaaagaatatcggaaagcgttttaaagaaaatcagaaatttgaacgcatctggtttcatatctcggaagcatttcggaaacggcgttttaaacttcagcagatcagaaaattccatatttataaatgcccggaatgcgggcaaaagatcaggatccccagaggaaagggaaggatcagcatccattgtccgaaatgcgggactgattttattaaaaaaagttagcaataatatagaagggaacaattatgaatttacaatttaagccggtcgaggcagaggatatacgcaaaatagcgcctttttatgccttacggcccaacaggacctgtgacagtgtgtatttagacagttttatctggagagattattaccatgtgaaatacgccataagtgacgggaaagcagtgcagtttttaatggaaaaggacggagagccgttttccgccatgcccatgtgtaaggaggaggatcttcctcattatttccaggagatggtagattattttaaccaggttttaaagaagcctctccgcatttttcttgcggacgaagaggcagtcaatttcttaaagctggacccggaaaagtttgaagtcaaagaagaagaggatttaaaggattatctttacgacggggaagccatgaggactttggcagggaaaaagcttcacaagaagaaaaaccatttaaactcatttttaagggaatatgagggcaggtatgaataccggacactttgctgctcggacagggatgatgtgctggaatttctggatgactggtgggagaataaggtggaagccgcagaatttgtccgtcagctggattatgaggtaatgggcatccatgatatattaaagaactgttctctgcttaacgtgaggatggcaggcgtttatattgacggtgatttaaaagcttttaccatcggcacctacaattcctttgaaaatatggcggtcattcatatcgaaaaggctgacccgaatatgaaagggctttaccagtttatcaaccagcagtttctgattcacgcatttccggaaaaaccggtgcttgtcaaccgggaggatgatgttggaatggaaggcctgcgaaaggcaaaaatgtcttattaccccattgactttgcaagaaaatacggagtagttcagaagggcttttaactatggtacggtatttgaagcaggaagaaaaaggcgagagccgggcgctttgggcaaaggttttttctgaggattcccagagctttatagattattattattcagacagggtgcggaaaaataagattctcactgcctggaaggagacccgcgtggtagccatgctgcaccgcaatccttatgaggtggtggtcaaggaccgcctgtggaaggtggattatattgcaggggttgccacggatccggatttccgccatcagggacatatgaggcggcttttaaaccgctgtttttccgatatgtatatggagcggatgggcttttgttttctggtgcccgctgaccctgcgatttattttccctttgattttacctatatctgcgacttgccggaggtggcgctgaacgaaaagggacggctgcgcttaagccgccgggcttttgtggagcggtcggatgaatgcagggaagctgcaagatttgtgggaaggcagctggaaaaaaggtatgaggtctatgcactcagagatgaggagtattaccagaacttaagcagggaagtgagaagtgacagaggggatttaatccttctttttaccagagatgacagggaagagctggccggcgtgtgggcctattacggagagacggcggaaaaccagcgggaacttgtctgtcttcccggatatgtaaaggagaccggcccattaaagccggccgtcatgggcaggatcattcacctggaacagttcatttctgtgatacgattaaaaaaggaatgccctgtcagcgagatggagctgtttatagaagtaaaggatgatttcatccgccagaatgacggagtgttccgttggaggctgggtcaggaaggttcttctcttcttcctgtaaaggacggagaagggatcaagcctcatttgtccttaagtatcagtgagatgacctcctggctgtttggatatgggatgccaaccgtgccggaggacagaaggtccatggtggaacggatccggccattaaatggagtgttctttgacgagattacctagcagatttttccggaaggagaatgaagcaggtcagctttggcgggttcgattgaatccgccttatgttttgcgcaggcaatgagccggatgaatatgtctgcatattcattgggtgaatgccgcggcagcctggaaaactcacaaggcgtgtgattctgggcttgaaaaatgtccggggcggccgccagagtcaagctcgcttgaccttggcccgctgccttcacgagaagaaaaggagagtcagttatgtatcaggcagcagaaaacagatatgaaaaaatggaatacaggcgttgcggaaggagcggagttttacttcccatgatatccttgggcttgtggcagaattttggcctggaaaagcctttggaggaacagagggagattcttttacgggcatttgatatggggatcacccattttgacctggcaaacaactacggctctccggcagtggggaaagcggaagaaaatttcggagagattttaaaaagcgatctgggaaaataccgggatgagctggtcatctccacgaaagccggatttgatatgtggcccggaccttatggaaactggggttccagaaagtacttaatggccagcctggaccagagcttaaagcggatggggctggattatgctgacattttctaccatcacaggccggatccggagacaccgcttgaggaaaccatgggagcattggctgacatcgtgaaacagggaaaggccctttatgtgggaatctccaattatggggatcgtgaggcaagggaagcggttcttttgttaaaaaatatgggagttccctgtctgattgaacagccaagatacaacatgtttgagagaggggcagaagaaggcctgtttgatacgcttcttgaaaacggcgtaggctgcatctgctacagtcctctggctcagggagcgctgactgacaagtatttaaagggcattccgcagggttccagggcttcaaagcagggaaccaccattggcggccgctatttgtcagatgaaaagctggatcagatcaggcagttaaatgaactggccctggggcgcgggcagacgctggcccggatggccctttcctgggttcttcgggaaaaagccgtgacttccgttctcatcggagccagcagtgtaaaacagttagaagacagtgcggcctgccttgataacttaaaattcacacaggaagaattgggaaagatcgattccattttaaaatagcagagagcaagagatgtttgtgaaagaggtcaggggcaggtgattgatatgaattacgaggttggagatattgtaaaactcaaaaagcagcatccctgcggaagccaggagtgggaaattttaagggttggcgcggattttcgcttaaaatgcatgggatgcggccatcaggtcatggtttcaaggaagctggtggaaaagaacaccagaggactgaaaggcaaggatggccagccaaaggcataaaatggcgaaaaaacaaaggaaaaggtccgggaaattgggaaaaggacttgcttttatcaaatgtttcctgtataatattaatccgtgacatatagattccttgctcctgaaactgaaatcaggggccagagaccacaaggaggtaacaagcatgaacaaatatgagttagccgttgttctgaacgtaaagctcgaagatgaagagagagcagcagccatggaaaaagttacgggttatatcactcgtttcggcggcgctgtaaccaacgttgatgaatggggtaagaagagattagcttacgagattcagaaaatgaaagaaggattctactacttcatcaaatttgatggcgattccacaactcccaacgagttggaagcacacattcgcattatggagccggtcatcagatacttatgcgttagacaagaggcataatagataaagaaagcgtgatcgtatgaacagagtaatccttatgggcagattgacccgtgatccagaagtaagatattcccagggagagcgtgctatggcgattgcaaggtatacccttgcagttgatcgcagaagccgcagaaatcaggacggcaatgagcagactgctgattttatcaattgcgttgcatttgacagagcaggagaatttgcggagaagtatttccgtcagggcatgagagtactgatttccggaaggatccagactggaagttatacgaataaagaaggcgttaaggtttatacaactgatatcgttgtagaagatcaggaattcgcagacagcaagggcggagcgtccggagaaggcggcggttatcagccggtttccagaccagcaccctccagtgcgatcggcgatggatttatgaatattccggatggagtcgaagacgaaggacttccattcaactaaatctaacaggaggtagtaccaatggcatataataagaatgataaagctgatggcgctaagatcagaagaggcggcatgcgcagaagaaaaaaagtatgcgtattctgcggagagaagaatggcgttattgattacaaagatgtaaataaattaaaaagatatgtgtctgaaagaggaaaaatccttccaagacgtattacaggtaactgcgcaaagcatcagagagcgcttaccgttgcaattaagagagcaagacatatcgctctgatgccttatactatggaataatcttaaacttcagatgtttataggaagactctgcatgaaagtgtagggtctttttttgaaggcagagttaatgaacagagcgtaaagtgcgaagagcatatgataatgacatgagttgtcacgtcaggaagaatatggtaaaatactgccatggaacaatcgtgtacagggtgtgttgatctcattctttatagaattagagtgatgcttatgaaatatgactttaaggacttgatgacctttggtatgtttctgcttgcattgcttacgttcattattacagtttgtaagtaatacatagaaatggcactgcaacaaaaagaaaacccaccctgatatactttggcgagcaggagccttatactatggaataaatcctttttttttggctgtctttcagccgggaagagaatttcatgataagggagacttcacatgagagtgtggggtcttttttaatatttattggcattttgatcagatgtgtgtggtatagtaagtcgaagtaattaaacttggatttctattgaagaatggtgtatcattctgctttagctgtagaaaaaatcaattttaaataagcattgaatataagtcaaaaatattcagtgctgtattttttacttaatctttgttatgatcaaataaatagaaatcaaaaagggggatacggaatgaatatcataaaaatcaagggagtatcggactcatatccggaaccggtagatggtaccatggaatggtatttctgcaaagacagcaatagttgcttttgcgatttatatgaggctgaagaaacagttaaatccggagaagtattttctggcatggtctgtcatttgattcattatccggagggaactgtttacagtccatttgtgcagagggaaaatgtttatattgatcagccgatctgggacaaggggatattatatttttcaggtgtggattttaacgaacaaaaaatacagatatacagctattttccagatagtcaaagacttgaaatgataaaagaacttcctttggggattgtggaagattgttataatcttatgttaaaagtctctcccctcatgctttgccgggatgggaacaacggaatttatgagattgtctggccggagaataaaaaaatagagataggagaaacagaaggattattattccgtgatggagataatttgtatttttctgaatggtatgaagacccggaatatcatgaaaatgtcataatcagagatttagatacgggaagggtgaaagaaaaatattctggttatctatgtaaattacctaatggagtgtattggaatatttagataaactgattgaaatgtttgtttagggaggaaccaattatgtttatagatacagactttcttagaagtgatgaaatatttctcaagttagaaaaaactgttgaaggcaatacagataaagattggcttccaacatatcactttgatatctgtgataaatttggcaccaaaatgggggctgcgatttacgtattggtcacaacgaaaaagtgtactatggaggcaatattggttattacatagacaaagaatacaggggacaccatagaagaagtagctcaattgccagatcaaagtgatatgagattaagcggagaatcggaaaagtgcatatatcgatttagtttacataatcctttggattagctaatgtatggaaacagaaatttgctgggcatagatttaacgaaaaaagagaggacaaaagcgatggtgcgagaaatattgaaacttggaaatccccaactatatgaaatgagtgaagaagttacgaaagcagagattaattctttgacggagtgggtgcaggacttacatgacactcttatggattatagggaaatatatggagcgggccgtgcggttgcggcaccacagataggaattaagaagcgattgctgtacatgtttacggataaaccctatattattataaatccggtgatgtcttttcccgatgatgaaaaatatacattgttagatgattgcatgtcttttccaggtctgacagttaaagtagaacgttataagcgtgcagaaatttcttattttgatgagaattttaatccacagaaaatgtatttggaaggtgatctttcggagctgttacagcatgagtatgatcatttagatgggatattagctacaatgcgtgcagttgataataagtccctttatgtggagcagatgaagcgggatttttgatgttattcttataattgaaaaatcatattgacatttttcgatttgatgtatataataatcaaatcgaagtttatagatgtgaggtgttaatatggaaagctatgaggaatatacaaaggtatttaaggcgttgggcgacccgaaaagagccatgattgtcgacatgctgtcttgcggcgagctttgtgcctgcatgattttggagaaatttgagatgtcccaatctacactttcccaccatatgaagatcctgtgtgactgcgggcttgtgaagggaaggaacgagggaaaatggacgtactactcattggatgaagataccatcagcaaaacaaaacagtttttctgcaatattacatccgacaaggaaagctgcatctgtaaagattccgcaggctgcaaaggatgtgatgggaatgagtaaatataatataggatttttcgaaaagtatctgaccctttgggttctgctttgcatggcagcgggaatcctggtgggaaaatacctgccggggattcctatgtttttagggaagtttgaatatgcccaaatttcccttccgattgcggttctgatctggcttatgatttatccgatgatgatgaaggtggattttaccagcattaaaaatgtcggaaagaatccaaaggggctttttgtaacatgggtgaccaattggctgattaaaccgtttaccatgtatgggatcgcagcatttttcttttatgtcgtatttaaaacaatcattcctgctgaattagcaaaggaatatctggcaggtgcggtacttcttggggcagccccatgcactgcgatggtatttgtatggagccatttaaccaaaggaaacccggcctatacggtggtgcaggttgccaccaatgatcttataatcctgatcgcctttacaccgattgtcgcctttttactgggtgtcggcggtgttgccgtgccgtgggacactttgtttttatctgtggtgctgtttgtagtgattccccttgcaggaggtattctgacaaggacgctgataattagaaataagggaaagaaatactttgaaaatcagtttctccccaggtttaatcatataaccataatcggactgcttctgacgttggtcatcatattttcgttccagggcaatgtcatattggaaaatcccctgcatatcgttttgattgcggttccgttgatccttcagacctttttgattttcttcatcgcgtatcttgcatcgaaatggttaaagctgccccataccattgcagctccggccgggatgatcggtgcctccaactttttcgaacttgcagtggcagttgccatctcactatttggcgccacttctccggcagcgcttacaaccatagtgggtgtgctgacagaggtgccggttatgcttctattggtaaggtttgccaataaaacccgtcattggtttcctgaaaaataaaggctggatcgtttacaacagagggggagcaaacaacagatgatgtggggatgaaatcaggggtaagaaactgctggagttataatagggagaaaaaataccatgataaaggttgcttttatatgtgtgcataactcctgccgttcgcagattgcagaggcttttggcaaacggctggcggataatatctttgaaagctattctgcgggaacagaaactaaaccacatattaaccaggatgctgtccggctgatgatacagctgtatgggattgacatggaaaaaacgcagcgttcaaaactgctttcagaaatccctcccgttgatgttgttatcaccatgggctgcaatgttgaatgtccttatttaccctgtaaatacagggaagattgggggttggatgatcccactggaaaaagtgacgaagagtttataaaagttataaggcagattgaacgcaatatattgtctctcaaagaaaggttgaaagctccgcaggctttaatccggtaaacttaatttgcttaatggtatccttaagattttataattttcaaaataataatacagagtcagaaaataagagtaccgccatacgttctgactctgtttatttaatgctcctgtggttcccatcaatttcaaccaatattaatgtaacataatcatctctgttttttgtaccgatctcaaagataagatattcctcataagcattctttccaagctttatctgatgttcatttgcgtactgcattatcttttcatacatttcattgatatttcgataactccccttatagtaaacctgaagataccagccttcctttcgcaccagagtgttttttttcttatcaacattgtttgtttttgtatacaaataagaaaagctgtcaaatcttttttcccggatattatcaatggtaagtgatcctcccagaaagtcaatcatgcttgcattgctgtcatttcggaatgcgatcaattctgtaagaaagtttgaataagaatcgtctttgccattatccatatgggtactgcatagagccttcatgcttttgtgataagcgggcttaatgatattgtattctgcggataaggcattttcagttaaatccttaagaaaatctatcccatgtttcgtattttttaattttataatttctttagccacttcatttgacttttgttccaataaatcaattaaattagcagggtttctttcatccatgtattttttaatttcttttaatggcattcccagcctttttaatgcagaaataatggaaaaagtatcaaattgccggaaggagtaatagcggtagccattctcctttgtgatttcaggctggaaaagctctatctgatcataataaaataagatatgtttggggattccgcagatttttgcaaattctcctgttgttaaatattcgtttttattttctgacataaaatcacctcattctgtgctgccttttacgggcctcctgtttgcgtccgtatcaaaggctttaattttatattttatcttgctgttttcttcttgactataagacaaccttatagtttataatagtcaggcagcctgttcctgtcaaggaatatggctgaaattatttgggttttattcagtaaaatgaaaggagttttgttatgcaattaatgttaaaatatttaaaaagatatcccaagctaattttcttaaacatcataggaatctttagctttgtagcggtgcagctgggaatacccacagtcatggcgtggatgattgataatggaatagggaaaggcgatatagcttatattaagaacatgggcggaatcatgctgattgtctgtatccttggaggtgcagggaccattttattgacttacgcttcatcaagaatttctacttatatgattcgtgatatcagaaatgatgtgtttgcccagtcgcagagattctcccatacagaatacaataaattcggcgtatcttccatgattacacgaaccacgaatgatgcgtttcagttaatgttgttttccaatctgttgtttcggactgcacttttggcaccagtcatgatttttatcagtgtttttatgaccatcagaacaagtatcaatctttccatggttatcggaggaagccttccgtttatcgtggcaggcgttattatcattgccaagctgaccaatcccctttccgagaagcagcaaaaaggtatggaccggttgaaccggatatcaagagaaagtttaacaggggtccgcgtaatcagagcctttcgaaaaagtgagtatgagtcagcgcgttttgcagaaaccaatgacgaatatgcatccaattccaagaagttatttaaaattatgtcatttacacagccggcctttttcttcttgctgcaccttgcgatgatggcggtgttttggatatcaagtgtaatgattgataatggcaccttacaggttggacagttggttgctttcttagagtatcagtttcatgcaatgttttcaattatgctgttttccatggtatttgtaatgtaccccagagcgcaggtgtctgcaaaccgtattcaggaattattagttgaggagccattggtgaaaagccccttcaagggtattacagctgaaaataaaggtatggtggaatttgaccatgttacgtttcagtatccggatggggagcttccagtgataaaggatgtatcgtttactgccaacaagggagaaaccgttgcatttatcggcagtacaggcagcggaaagagtacattaattaatttgattccaagattttatgatgtgacaaggggatctattaaaattgatggtgcggatatacgtaactatgatttaaaggcgctccgtcagaaaattggtttcatccctcaaaaagcatttttatttaaaggaaccatagaagaaaatcttaaattcggcaatcccaatgccacaccggaagaaatcgatcatgcaattgaagtggcacaggcaaaggagttcattgagaataagccggatcatttgcaggaatatatcagcgaaggtgcaaagaatgtttcaggaggccaaaaacagaggatttccattgcaagagcattggtcagaaagcctgaaatttacatttttgacgacagtttttctgctcttgactataaaacagatgcttctttgcgtacagcacttaagaaagaaacaaaagaatccgttgtattcattgttgcccaaagaatcagtacaatcatgaattcggacaaaatcatagtgctcaatgaaggcgaagtggttggaatggggacccataaagaattattaaagtcatgcaaagtatattatgagattgcagattcacaattaacaaaggaggaattggagcgatgaaaaaattatatccatatataaaaccatacctaaaattttttatagccgcaattctccttaccataggctactccgcatttttatcagcggcaccgatggtggaaggtttgattacaacaaggctgaaggatgatgttgtaaatatcgccaacaaagttcccggagcctccatcagcttttcctatgttataaaaatcttaaagctgttgctggccatttatataggaaacatacttagcaactttggttctcaatattttttaacaaatggcattcaaaacacaatgcgtgatttgagaaacgatgtgcaaaaaaagatcacaaagctgccgatcagctattttgataaacggacagtgggagatattctcagcatcatttcaaatgatattgataccatgtcaaatgctctgcagcagagtttgtcaagaatattaagtgcattcctatccgttattttggcaacagtattaatgttttatattaatcccattatgggtgctgtagccgttttgctcatacctggaagcgctttgatcatgaaatttattatgaaccgctcttctgctatgtttgagaggcagcaggtggctcttggtgacttaaacggctatattcaggaaagatacacaggattgaccgaaatcaagctatatggaaagcaagaagattccatagagcagtttaaggagattaataataatctttgtgaaaacggatttaaggcacagtttatttccgggctgatgtcacccctgatttcattcattacttatttaggaattgtagctgtttgcatattaggtgccatatttgcaattacaggtgccataacagtaggacagctgcaggcatttatccgctatatgtggcagttaaatgaaccattggagcaggtggcacaattgtccgcctccattcaatctgccatggcagcatcggcaagagtatttgagtttctttctgaaccggaagaagtaccggaagcttccaatccggtaaaaatagatgatttgcagggaaatgtagtctttgaagatgtatcctttgggtacaccgaagataaaatgctcattgagcatctgaatattaacgtgaaaagcggccaaatggtggcgatcgtcggacccaccggcgcaggaaaaaccacgctgatcaacctcttaatgcgtttctatgacgtaaatgaaggtgccatcaaggttgacggcgtaaaaattaaggatatgaggcgggatgaccttcgttcgatctttggtatggtactgcaggatacctggctgtttaacggaaccatagccgataatataaaatacgggaaaggggatgcggcccggcaggagatagaaaatgctgcaaaaactgcaaacgtaaatcattttatcaaaacacagccagatggctacaatatgatattaaatgaagaatcctcaaacgtatctgtgggtgagaaacagcttttaaccatagcgagggcgttccttgccgacccggctattttaatccttgatgaggcgacaagctccgtggataccagacttgagctaatgcttcagacggctatgaaaaatatcatgaagggcagaaccagctttgtaattgctcaccgtctttctaccatcagaaatgcagatctgatccttgttatgaataacggaaccattattgaacagggaacccatgaggaattaatatcaaaaaagggattttatgaaaagctgtatatgagtcagttccagaatcaggcctaaacaggctttatcgtatacagacacggcatcatctgcttttccgtccattcccggctgttgcgtgccggggttttctgttgcaagcattgcgcaaatgcttgttcttttttatgcagagtgatatagttaagtgaaaaagtttgttcctggtcagccggataaggggaaaatgtgaatcatacctattggggaggacggcggcatggacaagagtagagcaggcatttcatagaagggggcacagggatgtttcgtgtggagcaggttaagtcactgaatgatctggaaatggaagtatatcattatgtaacgaaaaactatgataaagtgaagtatatgagaatcagggaactggctttggaagcccatgtttccacttctacggttttgcgtttttgtaagaaaatggattgtaacggctatgcagagtttaagataaggctgaagcagcattttgataagggaaaggaattgcatgcaacggatgatgtgacggaagtcattgactttctaaagaaaaccacatcggaagaatttgagaaaaagctggatatgatgacggaagttattgtccgcgccaatcatgtgatctttgtgggcagcggcatgtccggaattgtggcgaaatatggggcaaggtatttttccagcatgggtaagttctgcctttatatcgatgaaccccattatcccacagaaagcaagttttttgaaaatgccctggtcattgtattttcggtttcaggggagtctaacgataccattggacatgtgatccgttttaaggaacaaaattgtcagatcttcagtgtgaccaatactgaaaactgcactgtggcgaaattatcggactacaatatagcttactatgtgacttatatgcggttaaaggtttacgacattactactcaaatgcctgccatgagcattgtggaacggctggggaaaaagctgtaccggtatacttccgaaggatcggacaatactttaaattaggaaatttgcatattaaaaaacatactgttacgtgaaaaaaacaagtgagaaacgttgtcacttgtttttttacgccttagaactgatgacaatagatctgataaacagtataatcacaatcagcaaaaaactatgtgtattcatcaattgataagagaggaatgaagaaatggcaagagattatgcggttgtatcaaaagcgattgtggaaaatattgggggagttgataatatttccagtcttacccactgtatgacccgtttgagatttgtcttaaaggatgaaagcaaggcaaatgaaggggcagtcaaagccattgacggtgttatgggagtggtaaagcaaggggggcagtttcaggttattattgggaaccatgttgggactgcttaccaggaggttttaaaattaggagactttggagaagaaagtaaagttgcaaggggagaaaagaaagagcctttgactctgaagaaaatcggaaataacattttagatgctattgttggaaccatgtccccgttgattccggcaattatcggtggttccatggtgaaattgctggttatgctgctggccatggcaaatatattgcctgcagacagcgacacttacaagatcatcaattccattggtgacggggccttttattttctgcctgtgatggtagctgcgtctgcttctaaaaagtttaaaaccaatatgtttctttccattgccattgcgggaacattaattcatccggatttccgcggtttgatggaggcggtaactgtgggagaaacggcggcccattttctgggggtccccatagcatccgtaaaatatacttatacagtaattccggcaatctgcatgacctggattttatcttatattgaacgtggcgttgacagaattacaccggcagtgacgaaaaacttcttaaagcctatgctgattttattaattgcggctcctattgcaattttaatcattggacctgccggaattttaatcggtacttcaatttctaaattcgtattctttgtacaggcaaagcttggattcctggcagtaggtattatgggcgcaatttggcctttactggttatcacaggtatgcacagggtgtttactccaacaattttgcagacgatctctgatacaggaatggaaggaacggttatgccctctgaaattggtgcaaacctttctctgggcggagtatccttagccgtagctttaaaaaccaagaacagagagcttcgccagactgcccttgcggctgcttcttccgccctgattgcagggactacggaaccggcgctttacggtgtagcagtccgtttaaagcgtccgttgatcgcttctttgattaccgggtttgtctgcggctgtttagcaggaatcgggggacttgccagccgttccatggtttccccagtgttttaacaggagttcagtttattgatccggagcatccgggaaccagtattgcatggattgtaggtattacgattttatcaattgtattgtcctttgtattgactttggtaatcggttttgaggatcttccggaagaggaggaataatttgagcgattttaaatttcctgagaactttctttggggaggggccattgccgccaatcaggcggaaggcgcctttcgcgaaggaggccggggaccaggcaacattgacatgattcctcatggagtgggaaggctgaaggtaaagacaggaaatgttccccgccctgaattgcagaaaggggaatattaccccagccatgagggaattgacttttatcactattataaagaagatattgctttaatgtcagaaatgggctttaaagtattccgtacttccatttcgtggtcaaggcttttccctgacggagacgaggaaaagcccaaccaggctggaattgatttttaccgcaatatgtttttggagtgtaaaaaatatggtatggaacctttggtgaccttgtgccattttgatatccccatgggactggtggaaaagtacggttcctggagaaacagaaaggttttagattttttcctgcgctatgcaaatgtctgttttaaggaattttcaggattagtaaaatattggctgacttttaatgagattaacattattttgcacagccccttttccggtgcaggaattgcatttcaggaaggggaaaataaagcccaggttacctaccagtctgctcatcatattttggtggccagcgctttggccactaagctggcacatgaatgggatccggagaatcaggtgggctgtatgcttgcaggaggcagtttttatccttattcctgtaatcctgaggatgtttgggaatctgtgaaaaaagagcaggaaaatttatttttcattgatgtccaggtgaggggagcttatccatcttataccaggaaacttttttatgataagggagtcagccttattatggaagagggagatttggagattttaagaaatacggtggattttgtttctttcagctattattccagccgctgcgtggctgcggatatgaacgataaggcctcgaatgagggcaatattatccgttctgtgaaaaatccttatttgcaagcaagccagtggggctgggggattgaccctctgggacttagaattaccatgaaccagctgtatgaccgttatcagaagcctttgtttattgttgaaaatggtttgggtgcaaaagacgaaatcaggcaggatggaagcatacaggatgattaccgtattgattatttaagaagtcatattcaggcaatgaaagaagctatggaggatggagtggagttattggggtatacggtctggagctgcattgacattgtatctgcttctacaggagagatgagtaaacgatacggttttatctatgtggacagggcagacgacggaagcgggacgctgcagcggaggaagaaaaagtccttttattggtataaaaaggtaattgaaagcaatggtaatgatattgcctgacaggaaatgtgcggttaagttctgatataatatttttaatttatttttgcagatgaaaatttaatctgatgatgagatgggagtctgaaatggattttttcaaggattgttatgattctagaaaaagtcagtttcagactcccttttcgttataaatttatcaataagcgatttaatgataagaaactctcattagccaaattgacatgaaattttggaaatggtaaaatttggttagttttccctaactaaagtgttaggtttgcatacaaattcaattacaaggaggataatggattgaaattttcttggggtaagaaaaggcttaaaaggagattgagcacagcgctggttttcattatggtaagctcctgcgttatgcctgcttatgcagacggaagcggaattaccgggaatttaaacagcaatgtttctttttctgaagatgttttatcagaagaatcattggaagctgcgccggaagccagttgggaagaggaggtgatttcagaggacaatgccggtgaaggagaaaccgtaatagatgaaacggctgaatcggatgaggcggcgcaggaaacggaagaagagaccatagaagaaccttcggaagagacagatgagaacctgggagaaacggaggcagagcctggagaaacggaggcagagcctggggagacggaagcagagccaggggagacggaagcagagccagaggaaacggaagcagagcctggagaaacagaagcagagccagaggagacggaagaaagcatagatgagacagaaggatccggggaagcggttgaggagacagaagaagatacggaagaatcccaggagccatccggcgagacaaaagaagaaggggaaaaaccggaaaacgagagcatagaagaaaccgaagcgccggttgagaatgcaggaccgttttctattgaagtaagaaacatagaactgatgggagactatgaggatggcacctataccggaagcggagcagggtataaaagtaccattactttaaagatcacgattgctgacaatcaaattacggagatacaggaaatctcccaaaatgagacattaagtaaatgggaaatggcaaaggtgctttttgaggagataataaatgccaattctaccgatgtagacgccattagttccgcaacatacagcagtgatggaatcatagaagcggtaaatgatgctttatcaaaagctgtaacaggcggcagccaggtgtttgaagatggaaacggcagtaaaggggatccctatatcatcgcagaaagcgtgcagcttgaacggtttgcccagaaaataaatgagggcaatgactaccagggaaagtatatagagctttccgatgacctggaattaagcggagaatggactcctgccggaacaaaagaagagccttttgcaggattctttaacggaaaaggccacacaatcaccggattgagcatacaggaaaacaacgtgaaatatgccggtctttttggttatctggcagcaggggcgaaggtttctgacgtgaagctggaagatgtaaatatttcccgtgaagctggagccactgaagcaggagccatagcaggaagcgcggagattggggtcattattgataattgccaggtatatggaaccattgaggccagtaattccacaggcatcagttatgccggcggaattgcagggagattgggacaggaatccgtggtatccaatgtttatgcagacgtgacggttgctgcattttcaggaagcagcagtgcttatgctggaggcgtgatcggaatgtccgtaaacaaatgcattctgataaatggggcatccgttggaagcgtttctgctaaaacagatgccggcaccatatgcggtgcaggaggtgtattcggtacccagtccggtacggcgtacaatgttttcagcaattgtgatgtcacagcggaaagcgcagaacaaagcaaggctttggctggcggaataagctgtatggccacaaacaatactgcaattgtgaatggttatttcaataacagcattgccaatgcatttatgacagcatccagcgcgattaacaaatatgtggctgaaaatgtggtgagcttatgggattcggaattcaatagtcaggattttgcagacacattaaaccgcggcttaacaagatcacaaagagcaggggggattgcaaggatttcagaagcaggaaatcagaacatgggagatcttgaacatgcgcttgatgctcttgatattctttatgcttgggattatactggcggagtcattctctctggggaagcctttgtggatgacaccattgatacgggcatatttgaaagcggcagcggaacagaggaagacccatatgttcttaagacggaagaacagctcagggcgtttgcaaagtccttatccgatgatgtcacttattccggtatttatatagctcttgaggaagatgttgatgtttccagtgaaacctggcttcccatcggacttggacactatgatttcagaggaacttttgacggaaaggggaacaagattacaggaatacgcatagggacccaggaagctccttatgaagaggagtccggagacagtcagaatctcagcaaaatgacgacctattatggattttttggcgttataggtgaaaatgcggtcattaagaacttaggcatagaagattccgtaatttctgtcaagagaagtacaagtatttatgcaggacttcttgcgggtgttacagacagagcgtatgttgacagctgctatgcccaggggtatgtttccagcgaaacaactcacagcaaagcaaatgcctgggcaggcggcctggtaagccagactattaaaggcggaatcattaattcatggtcggatgcggaagttttctgtacggcaatcggcggtcttgcggaatccggggcatttataggtatgacaaacagaagtgttgttgcaaactgttttgccttgggcaatacaggaggaaaagccagcagagaagatggcaacgaagggatgccggcggtttcttccttcattggtgtaaacgcaggtaaagtagcaaattgttatgcttccggcgatatgaatgcggcttctttttctacttatgtgggatccttttcaggctgggcaacaggcattgcaagacagtttatctcttattataacgcagacgcggtccagaatagcaacggaaccatcaacaatccggtgatcagcgttggttttatggtgagcgcaggggtaaatgacgaaggcgaaccttatgatggtacttatcatgtgggaattgaggcaaaagaactgtcatttatgaagagtcaggcgtttgccgatcttttaaacagcaatttccatgcctttcctctggatcttgtaaacggagaaagctccaatgtgggaaatcagaatgccatgggtcttcctgaattcatgaagctgaaagaatggcagctggaaaatgacgttgttatgcctgtaggagaaacggtaatcacgacctatgaagatatgactccggtatttgaaccggatgcccttgacgtggctgacggcacttattatggtagagcaaaagggccgggcggagaatatatttatgtgaacatgacggtagcggaagcccgtatttcagagatccatgtaacgaagcacagcgagggaagccagctggattccatttctcctgaaatcatagcctccgtaatatcggctcagaattattcccagtcaggcagtgacagtgaacttgggaaagctttgaaaagtgcgatcgcagttgcggcacagaaggccgccatacgggatatttccggatacggatatgtttcagacaccatctttggggcaggaaacggcacaaaggagaatccatatctcataaacactcctgagcagttggtggcgttcgccggttctttaaatgaagacgagcattatgatgggaagtacgtgaagcttgggaatcatatttctctggacggaattgaatggattcctgcagggggatcaggagtgtatggtttccggggaacctttgatggaaacaacaaggtaataagccatatgaccatcggttctccggaaaatccggaaatgtactgcaagtcggttggccttttcgcaaatctggaagcagccaggattaaaaatcttggaatcgaaaatgcatcgatttaccaaaagtatctgggcgattccatcgcctattccggattgctgtctggatattatattgaaaatgcaggtgacggcgggtacgttgatttttgttatgcagaaggaaccattaacagctatgctgcaaagcaaaatgacagcggaggcctgatcggggccattaacagaggaaccatagcaaacagctatacaaaggctgagattaactgtgaaagcagggatggctatgcttatgcgggaggcataagtgcgcttcctaacagggctttgatcattaacaactatgccttgggcagcatcaagggcaagggaaatggagccaggattcagatcggtggaatttcaggcatgaacgccggcataacgatcaataattatgccagcgttgagctggtttcagcgaatacaaccgtagatatcggaggcttttcaggaagagtttcaggaattggatacgtagaacgggcttattataacagcgaagcaaaacagataagcggttctctggaaatccttccggccaaaggggtcggcactgttgtttccggtaccaactacggcaaagggatagtcgtggatttagaaggaaagagcttgtccgatttaaaacgtccggaatttgcagagactttgaatgcaaataaagctgatgcagaaataataaaaaaagcgggcagtctgttagtagaactgggttctgggattccttctgaaattactctccgtgattttcagtattccgcaaatgatgacggggtagtattcaaggacagagtgtcaggttctacagacggaggatcatcggatggaggttcgccggatggaggatcatcggacggaggatcatcggatggaggatcatcaggtggaggttcaaccggtggggataattcaggcggtgacccatcagacggcggcgccaccagtcatgattcttcaagcgagagctcttctgccggcacagaaacaaaatcctccgccaatttggcagaccggcctgtcaaagcagatattgctgtgacggtaaatgttggagagaatggttctgccagtgtctctgtttccgatcaaactattgcagaggcaatcgccagggcacaatccgatgccagagtgcaggggaaaacggcaaatggaatttccatagcaatcaatattgtccttccaaaggaggccagatccctggttgtcgcgttttcaagaaacgcactggaacgtcttgtgaatgcaaatatacagagccttgatttcaatgggactcttgtgaccatgggccttaataagaaggcggtggaggaaatctgcagacaaagcggcaatgacatcaccatctcagcagaaccggttgatataagcggtgtccgcagctgctatgacatcaccattcgttccgtaaaggatggagaacccctgactgttacagacctgaaagagggagctgctgtcatggggattccgtacacaccagaaagcaatgaggactcaggacgtttgtacggagtatatgtggatgacagcggaaggatcagccggattgcaaattcggtatatgacggaaacagcaggcagattctcttcctgacagatcatttttccatctatggtgtgggatacatggcttctgccccggcatttgcagatacacaagcacattgggccggggaatccattgattatataactggccgcggacttttgccgggcgtctccgtttccggatttgcaccggaggccgttctgaccagaggaacgctggcagcggctctgggaaagctggcagaggctgatgtaagcagttatacgggcagcagcttttctgatttggcaggcaatgagcaggcaccttatgtggaatgggcataccggaatggaatcatccagggaaccggtgctgatttatttgcacaggacgctgcagtgacccgtgaggaaatggcttcagtaatgcagaattatgccagagtcaccggtttttctctgccggtcactcgctcccaatacagctttacggattatgaaagcataggaagcgaagggaaagctgcggtaacagccatgcagaaggcaggtgttatgatgggagaaagagacggcagttttcagccaaaaggcaacattacccgtgctcaggcggctgttattctggagcggtatattaagctggttatagatcctaaaactgcagagggctgggcgaaaaatgattccggtcagtatctgtactacaaaaatgggcttgctgtcaccggaacagagatcattaacggagtaacctattatttttctgcagctggaatcatgcaggaaaactaaaaagtaaaagattctgataaataataaataaagttggcctcctgacatggcttttgtatccagccatgtcaggaggctgtttttatttcagcgaaataataaaatgaatactgcattgatgaaatatgcagtttttgtaatgggattctggtaaataagaactatttgatatataattattagcagtagaatattcagacctgttatttgtttcaggattttattgcaatcatgggaagccggggagaataaccttgggatttgggaccaatgatatgggattatcaacacttattcccgatattccgctgtatacaagtatattatttattgaattttgttgggggaaaacctatgaattatataaaagctatgatggaaaaatcaagaaaggcggcggattatgattgcgatttatgattggtttggctatgaattgcccataaaggaacgatatcagctaataaaaaaggtcggatttgacggcgttttattatggtggagtgaaggctttggccggaattattaccgcaacgcgccgcaaattacacgtgaggcaggtcttttaatagaaaatatccacacgccggtggaaaaccaagacgatctctggcttgacaatctggatggtgttgctttaactgattgctatttgcaatgcgtttcagactgcgccgaatttgagattcccacaatggtggtacacctgccaggcgaagacaagccatataacaccttgggtctggacagaatcaagagaatcactgaaaaagcggagcagcttggcgtcaatgttgcgtttgaaaacttacggaaccttgtcaatttggcatatgtgctggatcaggtggactccccgcggatcggattctgttatgactgcggacatcaccaccgctattatccgggccatgatttattatccatgtacggttcccggttgatggcactgcatttacatgatattggcggggcttatggccaacaccagttaccctttgacggacccattaattggcctgcagccatgagaaagattgctgaaaagaagtattcaggtgcaactgcaatagaggccatgaattgggattataagcatttatcagcagaggaatttttgcaggaagcatttgtgcgggcaaaaagactggattcgttaagactctgtaaggaggggttagtatgattcataaagaagatttgatcaaaatgaataaagaagagctgacaaaattatctgctaaattacagaaaagcagatcccttgactctgggccattttaccacggaacaaaagctgagctgaagaagggggatttgctggaacctgggcacggctccaactatggcaaggggaagcaagctaactacgtgtatctgaccggaacaatggatgcggctaagtggggagctgaacttgcggtgggtgataggcccggcaggatctattgtgtggagcccacaggaccctttgaggatgaccccaatctcacggataaaaagtttccggggaacccaacccgttcctaccgaacccaatatccattgaaggtagtggacgaagtcctggactgggaaggacattccccggaggagcttaagaaaatgagggatcaccttgatacgcttaagcgactgggcattgaggcaattaacgactgacatcattgctttaaaaagtgaattccaatgcatcttaggagataaaacatggagaataataaaaaaataatccgggcaatagaagaatactgtataaagcatcctggcgcatatgaggcaaggccatttggagagtatccaatctgctataaggtcatgggaaagatatttgcgcagcttaatccggaagcagggttttataagatcacattaaaatgtgagccggataaagcaaatctttatcggcagctttatccggggattgtgatccggggatatcactgtcctcctgttcagcagccatattggaatacagttaatctggatgagttctctgatatggaaatgctttttcagatgattgatgaagcatatgatgctgttattcataaattcagtaaaaaagcaaaagcggacttgctaaatctgtctgaattggagtttaaagatacggatggagaagatcaggattttgcattgctttgcagcaggctggacagtgctcttgatgaaattgttggcgggaaatttcagagaagtcagtatgaacagtataatcaaagagacagcattcatgacgtgattgtggcttatcagaaagaaaagccggttgcatgcggctcctttaaaatgtatgatgaggatcatgcagaattaaaaagaatatatgtggaaccatcccatcggaagatggggctgggtgcagaattggttcggagattagaagcaaaggcaaaaatcaaaggatatggctggtgcattctggagaccggaaagcccttagaggctgcctgttgtctgtacaaaaaggcagggtataaaatgattccaaattatgggcagtatgtggatatgccggattcaatctgtatggaacgaaaaatctgatggggatagttcaatggagaagtatgaacttggtttaaagaaaaagtctttttccttgttttttaatgggggagaaatatggtgtgaacatttggattccctccatggggaaaaggaattgttaaaacagaagtttgaaggagatttaatacagatcagcagaccgtctgcaagttcctttatcatagttgttcttgatgaatcagatgttgacagagaaattctggacctgatcgttgacaggtttgttatgttaaagaggccgctgagcaaagtggtttttgtgggactgaatttaaaaatgaagggccatgttaaaaagagaaaagcagatatttcatttatgatggcctgtatcgatgatatggagaaggcaaaggaatggcttgtctcgtaaaaaaatgatccggatggaaaattaatatgacatataaattttcatattattctgatgaatattttgaccagattgaggagctgatacttcgcagctatggtgcaggcgtaaggggattgcaagagcattgacttatgagttagccaacaggggcatgaaaaaatatccattatgcaaggggatggctggaggtgcccaacagttttattgggatttttaacagaagctgaaaatgaaatttggaaatgggaaatgaagttttaattatataattcaagtcttgtacaacacagatttataagagagttcaattgtttaaaacaggacttcgcatgaaaatgtggagtctttttcatgttgtatctgataaatcacgtatcaatagttggttcggttcattactgctttttacaaaattgatacatttatatgatttcttatatagtaagttgaacaatatggaataataaggtgaagattattgcaaagtgataaaagggaaaacggagggaaaagaaatagaaatgcataatattttaattatcgaagatgaaaagcccatatctgattttatcaggctgagcttaaagactataggatatgaatgtgaacaggcatttgacggggaagaagcagcaaataaaattttggaaaaacgatattcgttgattcttttagatgtaatgctgccaaaagcaaatggattcgaattaatggaatttattcgccccatggaaataccggtaatttttttgacggcaaaaggaagtgtacaggataaagtaaagggctttaagctgggggcggatgattacctgacaaagccctttcagattgaagaattgcaggtccgaattgaaaacgtactcaggcggtattataaaatggatgaaatcttatcttataaaaatatttcagtgaatgtttcatctcacagagttactaaggcggaaagggagattacgcttacagaaaaagagtttaaattattggtgttatttattcaaaataaaaatctggcattatttagagagcaaatatatgagaaggtatgggaaggggaatataccggagacagcaggacggtggacatgcatatacaaagactgcgcaaaaaattagatttatatgatcaactggtatctgtatttaaagttggttaccgtttggaggaataaatgaagctttcctggaagatattctcaaatacatttttggtcgttttattttctttaactttagaaggagttgtatttctgtccacaacatttcataaagcatatttgctggaagttgagcgggaaaaagaaaatatagaaaatattcatagggaattggtaacggtgctggcaaatgacagcagtacgctgtataaggagccaataaaaagcattgaagctgcaattgatattttggaagacaattggcggggtgaatcttatagaataagtgatgaaagcggaaaggtgctttttcagaatcatgatgcagagtttttggataaaaagggaagggaattatctctttacaggattgtatatggtgtagaaaagaacgagaagggatattttttgcagatgtcagttctgacaaagctgctggaaaagcctgttataatagaggtcaataaggacttaacacagatttttatggagaaagcggagcagcaaagaatatttgtaataaccataattgccgttggagccataagcgctttgattaatgctgccaatgttattaaactgactaagccaattcacaaattgatttttgcagtgaaaaagatcaggtcaggggattatacagagagggtggaatataaggaaagagatgaagtcggcatattggcatctgattttaacagcatggcggaacagttagaagaaaagatccgattgctgaaggacacggcaaaaaagcaggaagaattagcgggaagccttgcccatgaaataaaaacacctcttactgccatgataggatatgctgatttaataaagagaagcaaaatggatgagcaggatttcctatatgcggttaactatattatttcagaaggaaagagactggagacgctatcaaacaggatgatgcagctgttgatagaaaagaatgcagtgcccaataataccgtcagtacggtgcagaaattgctggaggatgcactggaagcaatgagaccagtctttgacaaaaagaatattactgtaaaaaaatcttctatggattttcccataaaagcggatatggagcttatgaaaaatgtattattaaatgtattagacaatgggggaaaagcagcaggaatgaatggggagatttccataaaatccggatgtaataacagtcatgtatggatttcaataacagataatgggatgggaatggcgaaagaggaaatttctaaaatcagggaggcattttaccgggtggataaatcccgttccagggcggaagggggagctggcctgggattagcaatttgttctaacattatgaacattcataatggagaaatgctgtttgaaagcgagcctggtaaaggaactacggtaacactgacatggaaaggaattgtggatgaacatgatatttgactatgtaatatattttaccaagatatctgccttggcttttggaatcctgattcttccgcatttttattttcaatatcaggaccaaaggctgttccgtgagataaaagaaatggatatgaacgtttttcaattggacaggatgaatcgtaatgccttaaccacagaggaaaaaagggcattattatctgacggtgatgtaaacctaaggcatattgaactcaagacaggggacaggtatagtttatatgaagcgcgcaggcaatgttttcgagaactgagcaagatccctgttctggaggtcagcatatacggtcccatattaaatgagattgatataaccccttacctgctgattgacccggaaacaccgtcaagttctatgcttatttggaaaggttttctgacaataaaggatattaaatatcagattacattggaggaagaaagcggtaaagtcctgtctatccagcctgtaggaaaagaggatgatgttttgaacatgcagtgggaaaaatatttaaaagaacctcaggaataatacaagtttgttacatctatttgtgaaaatacagtggaacttaaaaaacaaatggaggatttaaaaatgaaaaacaaaaattacaggatattactattgggaagccttgcaattgctgtaacgctgtcagtgagtgcttgcgggaataaagcatcagacctgcagcggaatgataaagctgccaaagtaacagaggaagcagtccaaaaaggatcagcggaaccagatgatttagaggaaacatcggttgccgatgtgccgaaggttgccgataatgtaaaggccggaactgatgaaatcccgatggtgaaattaccggaaggcatatcaggtatgaaagcagagactaaaccgtttaaagaattgagggatctgatcattgaagacatggaggtaccggaggaatattacgaaacaacacattacttttataattactttgatttaaatgatgacgggaaagatgaaatatttgttatggtcgcagggccttacaccagtggctccggtggaagcagtgcattgctgctgtctgaaaacggtggaaagctgcacattgttcaggagtttacattagtaaacgaacccgtcataatcagcgatgagctggacaatggttaccataatttaatcattccatattatagtgaaagcaagactcagtattctgtattaaagtataagaatggagcgtaccctaatgtgccggatggagaaatgatccaaagtctggaggggattaaaggaaaagcaatcattgccaatgacaggataaatgaggttcaggcaggaatcatgggattaagccttagtgaaaaataaatcctgcagacaaacggcatagaaaacccgaagagtgaaaaccttcgggttttcgtgctttgagtccgccgcaggatatgatctcctgccctttgatcacaaactgtcataagcacaaaatgtattctcgtctaaattgttctcaaacagatactgctcgattgtgttgccgatccgctttaaaacatccctgatttgtacggccttttccggcgtgtcacggtaagtaggaacgctgatggacacgcttgcaatggttttctgattacagcagataggggtggcatagcagcagatgtccgtgttggtttccctcttctcataagcaaatttgttggcattgagttcctccagctcttgaaacaaacggtggaagtctgtgatggtatattcggtaagaggctgaaggccgtttggataaagactccttactttttcaaagggggcctgatacagcaatgcttttccaatcgctgtacaataaagcgggaaccgtttgccgactctggaagaaagacggatggcttctttggaatccacctttgcgatatacagaacactgtcttcggagcggatgccgaactggcatatctcgtttgtctcattcactgcatattccatctctgtctttatgaactgcatgacacttttttcgccatagtaagtaagccctgaaagataggtctcaattccaatcgtatacaaatttgtatttttatgaaatgcaataaaattcctgctggccattgtgtgaagaataggggcgatggtcgtcttgggtgaatcaatatttttggcaatatccgacatgctgaggccggatggatttgccgccagcagctctaaaatatttaaaacgcgttccgttggtttgtgctcaatattaggcatggtctgctcctttatccatcattgctgtgtctattataccaaagtcaatttcaagaaagccattggtaaaaataaacaatataaataggaaatatatgtatattatgtcagaaatgtaaaaagcgtattgacatttatggaaaataaatatattctttcattaaggtgtacgaaaatgcgcataacgtacgtaaatacatataaaatgaaagggagtaaaattatgataatgaattttctaaagaaagttccagccggaatgatgattgttccattgctgatcggggctattttaaatacgtttttccctgcggcacttcaactgggctctttgacaacagccaccttttcaaatgccggagcagcaaccgccatgggaatccagctggtctgtctgggcaccaccttacagatcagtgatattggaaaggttctgaagagaggcggcatcctgttgctttctaaattttttatcggagcggccattggtattgtggttggcaaactctttggtccggcaggcgtgttaggtttatcagccttggcaattatcagcgcggtgacaaacagcaatggctctgtttaccttgcattgatgcagacctacggggatgatgtggatggcggagccatggcgttgctggcattaaatgacggaccgttttttaccatgatagcgctgggggcctctggattggctaatattccttttaaagcactgattgcaaccattataccgattttagtaggaatgattctcggtaatctggataagaacttctctaaattcgtatccccggctggttctgtgctgattcctttcgtgggattgacactgggcgctggtattaatcttatgaatgtagtcaggggcggcgcgcccggagtgcttctgggattagttaccgtatttattggaggcgcgtttatcgtattctgcgacagggtaatcggaaaacgccccggatatgcggggtgggcggttgccacaaccgccggcaatgcggtggccgtacctgctgtggtggcgttggctgacccggccctggagccctatgtggcaggtgcaacggcccaggtggcagcagcagtcgttgttacggcaattctggctcctttgatgaccagctactgggtaaagaagtatggaagcccccagatgccgctggaagctgaagccggcctgcatgtaccggcggaaaataattaagaaaaataaaaggaggatgaacaagatgagtgaagttacaacaaacgcaatgatcattgatgagaaagatactgttgcagtggccatcgagcctgtggaagttggcagtacccttgcctggttagacaagaatggcgaattacataaactgacagccttgactccaattccgatttatcataagttcgcaatcaaagacatggaaaaaggtgagcctgtggttaaatacggtgagcatatcggtctgtcggggactgatattcatgcaggccagcatgtacacgtccacaatgttgaaaatcacagagagcaattataaactgcatacaggaggctgttattatggataagaagacaatgaaagaaatgacttttatgggttataaaagaccagacggaaggatcggcatccgcaacaaactgctgattctccctgcaagtgtctgtgcctcggatacaaccagaatcattgcatcccaagtggagggcgccgttacctttaacaatcaaaacggctgctcccaggttccttccgatcagcagttcaccatggatgttatggcaggatacgcggcgaaccccaatgtatacggaacagtagtaatctccctgggatgcgaaaactgccagatggatctggttctggaggcgatcaaggagcggaccaacaaaccgattgaacattttgtgattcaggaaaacggcggtaccattgcaaccatagaaaaggccgtccgtgcagccagaaaaatggcaatggatgcatctgcgctgcaaaaggaagaattcagcatgtctgagctgattgtaggaacagaatgcggcggttcagatcctacctccggccttgcgtccaatgtcctgatcggtgaaatcagcgaccggatggtggaaatagggggaacctcgattttatcagaaaccacggaatttattggagcagagcatattttggcacagcggggtaaggataagcgggtcagtgaccggatctaccagatcgtacatgattacgaacatgccataaagctggtgggccatgacgtccgtgaaggcaatccttctcccggaaataaggaaggcgggctgaccacactggaagaaaaatccctgggctgcatccacaaaggtgggcatacccctgtcaatgaagtctatgattatgggaaacaggtggacaaaaatatgggtctggtaatcatggatacccctggaaatgatccctcgtcagtagccggaatggttgccggcggctgtcagatctgtctgttttccacgggaagagggactcctaccggcaatcccattgttccggtgatcaagattacgggaaatcgggagacctatgccaatatggtggataatattgatattgacgcaagcccctatatctatggaacaaagactctggaaaagctgggggatgaactgctgacagagatgaagctggtatccgacggcaagcttacaaaggctgaggcattgggatatacggagatggctattgccagagtctgtaactacatgtagaaactattataatgaaggaaaaaggcattttatgaaatatatcagatttgtgcccccaggtgagagtgtcaaaatcggaatccttttagaaaactgcagaatcctgccgctgcaatcggtaattcccggactgatatcggaagatatgattgaagtgatacggtatgcgggaacagccggtggaatggaagaactgtcatgcctggattatgaatccaaaacaagtgagatgtatgatctggattccgtaaaagtccttgtgccgattgagcggccggtacacgatatcatctgtgtaggcgttaattatgaggatcacttaaaggagacaaaagaacatcttggaacgaatgagtttcagacacctttaaaggccgtgtatttctccaagcgggccattcgcatcacagggcccggtgaagagatcatcagccggccggatctggatgaagggctggattatgaagtggagctggcagtaatcatcggaaagaccggaaaaaatattccggctgaaaaggcagaagattatattttcggatactctgtattcaatgacatctctttcagaaatcttcagaccctgcacggacagtggttttacgggaagagtctggacacctgtgcggccatggggccggtgattgcaggaaaagaagaatttcccttcccggtggaactggcagtaaaaagcgtggtaaacggagaactgcgccagcactccaacacaaggaactttattcatgatatcccttccctgatatctgagctgtcggaaggcttcacgctggaatgcggggatatcattgcaacagggaccccgtccggtgtgggaatgggatttgcgccgcctcgttatatgaaaaagggcgatacagtgacctgtgaaattgagggaatcggcaagctgacaaacagtataagctagctgtgattaacattagaaagaggtgctcctatggaagtgagtttttacactccggttgtaacagcatttaatgaacacggagaattggatttagacggcaataaacaaatatatgaccatctgattaacggcgggatcaagggtctgctgattttgggaagcagcggtgaattttataccatggacatggagcaaaagaaagctttgatcgatatggcagttccatatgtcaataaacgggcaaagttgttcttcggaacagcctgcagcaccatggaggaaacattggacttaagcgattacgcccttaaagcaggtgcggacggagtgatgctgatcagcccttattattttactctggatgacgcatccctggagaatttttacgatgaagcggcaaagaacattgcaggccctgtctatatctataattttcctgacagaacgggatatgacgtcaggccggagatcgtgctgcggctgctgcggaagcataagaatattgtgggacttaaggattctgtttcagagatgggccacaccagagccttgctgacaacggtgcgggaagaatttccggattttcaagtctactgcggctttgatgaaaacctgatacataatgccgcttgcggaggcgccggctgcatcggagggctgtccaacgtatacccggaactcatgacccagtggcaggatgcggttaaccggaacgattggagtttgtcgttcgcgctccagaagaaggtagacatcctgatgggcatctacgatattaacccgttctttgttccgatattgaaaaaggctatgatgctgagaggcgtgggaatcagggatcattgccggaagccggtccttcccgtgactgatgaagaaaccagacggcttgaggaaattatggggaaggtggacatgatgcagcagagcggggaatcagatcgctgatatgaaagagtaatgaaaagcaataaaaagcaataaaaataaaacaaactggaagaaacagttttccgccggctcctcagtgatttgttaaactgaggaaccggcggcttttttatcattgggaggaaaaattttaacttcgtgtataaaaaatgcaaatatggcacaatctaactataaatacctggtgaggataaaaactgatacttgggatcccgtatgtcaatgcgcggatgcttttttggttctgataaagatctgtattaattgacagatcatcacacaaataatgaaattttcattataaataaagctttgaaagagaggaaataaacatgggaattataagttggattattattggtgctcttgcaggttggattgccagtatgttcaccggtaataataaaagtatgggggctggtgccaatattttggtaggaattgccggcggattgatcggcggattgatcatgggcctcctgggaggaaccggcattaccggatttaacatctggagcctggtcgtttccgttgtgggttcggtcattttattatccattgtgaatgcaatgagaaggcagagagaatagattgatttggcggttcatgccataagaaaagatatcctgatgccatccggatacggttgtttaaacaataaggggtatgtcaaagaaactgtgtaatagagcacagagcatttggcatacccttttttctgtagaaattctgctgtctgcaggcaggtaaataatagttaagaaactttaaaaatagtcccgaaaataagatgaaggtgtaaagacgaatcaaatttcgtagaaaatccgaataaaaaacagtttgagagatatgtgatattgtgcattatatacatgaaaataaagaaaaaatcataaaaaaataccataatcattgacttgaatttccattttgcctatgatatactgtttgcaatatataattattaaataaagttaaataattgaatgaggttgtgtaatggaagaggaaaagaaaagcatgagctttcccaagggactgttctgtgtttatcttgtatttttttcaggtcaggcaatttataatacatatttaaatttatatctggctcagattggtttttccacaactcagataggaagcataatatccatatcctggatcctggcggcagccatggccttatgcctgctgttttccttatgagtttcaaagaccggtatgattttatgaattgtctgggaggcatctgcaatggaatcaccagcgatgaggacaatgaagaaggaatcgcattgatccgggaaccaggaggcacagtcaatgataactggcgctgggcggagcaatggattcctcatgtatcatggtttattcttgcacaggcttataaacagatataggaattaatctttaaacagagcctccagacgtttgttaaacactgtgaccgcagcgccgataatgcctgcgtcacggctgatggaaggctcgatcagaagggtgttgtgtgtcagggtggtgcggactgtatcctgtattttctgcagtaaaccttctcctaaagcaaggggcacaattcctgtcagcacacagtgctggatatccaggagataggatatgttggcaagggtaaagcttaaataggggcagagataattaataatatcttcccgtatggactccggcaggcccggattttgctggaggctgatctggaaatgcttatagatggcttctaagttaatcagctgttcgaatgtggttggttctggcacctctgttcccggtatctggcaggaactgatcatcatgtttccgatctctcctgatttgtgagtggcaccataccacagctcgccgttcatcatgtagctgacaccgcagcctgtgcccagggtgaaatatatcagatcctggtattccgggttcttgcggcgtaagaaagcttctccctgacaggcgaacttcacatcattatcaaggaaaaagggaacggtcaaagatgaggcgaattcagaaaatgcatcttcaaacggaacctcatgatcaatattcattcctgacatatgaatgatgctgttagtttccgggttaatcatggcaggaaaaccgattccaatacccagaaccggaatgtggtcattgtcagccaaagacattaaggtattgatttcctttgtcagcttagataatttcaaagtatgattctgagcaggaagataaatggatctgcagtactggcaggtgcccagcatatccaccaggcccagatgaacaacctggccttcaaactcaatgccaatggcatagcaggctcttggattgaacttgaggaggtggcccttccgccctgctcctgagctttgttctgtctcttccagctcaatgacaatgcccagttccagcagcttatcaacaatttttgaaacagtgggaaagctgatgcctgtgatgcggaccagttctgcccggctcataagatgctggttgcggaataaatcaaaaatcatcatacggtttttggttttaagatatcttggcatgtactggttcaaggcaaagctcccttctgaggtatcattatactagaatcatagcattagaactacagccagtcaaacgattttcagctttctataaggaggaacacatggcacagaaaatgatggaatacttgaaggaacaacctgcagtatggggaaaaattgtaaaggaaagggaggagatattccgggagctgaaggaatatggaatcagacctgtaaagcgaattctgctcattggttcaggcagctcttatattgcgtcaatggcagcagcagattttatggagaacattcttggaattgaaacaactgcagcagtacccacccgtttaaatggttttagaaaggttttaaagccggaagatactcttgtcattgcttcctcgcaatcaggtaaaagtacttctaccatatctgctgtaaaagagtggagggaacatggatttacagttataacggcaacgtcagatcctaagtcacctgttgctttacatggaagcatgcaccagctgatcccatgcggtgaggaagccgtagggcccaagacaaagggaatgacaggaacggttttgactctgtctcttatgggtctgattctggggcagctatggaaccgggtggaggaaggacagtttcatcatttcttggatgaaataaacaaatccatagaggcagctcctttcaatatagaggcttccatggaattttgtaaaagaaatgaagatctgctttcgtccatgccgcattttaccctcatatcagaggaagccggatattatgcggcccaggaaggggctttaaaaatcctggaaaccttgtatgtacctgccgcagcttatgaatttgaagagtacttgcatgggattaacaataccatagagccgggaatgtgcaatctgtttctgcctgccgggactcataattcagaccgtatggcagtcttggagaggtattccagagaaaagggctgtattaattttgtcataacctccctggattgggagaggggcagtcatgtcctgaatctgaccggaagcagagaaccctacttttccatgttccaggctttgcttgcttttcaggttatgagtgtttatgggtcggagcggaaatgtattgaatgcgatacccccaaattccatgatttttatcaggtaatgaatacaaaagcttaatttaggagggtattatgaaatactatgctggtttagacataggcggaacggttgcacgaatgaagatcgagtccgctgagggcaaagtcattggagagttttatggtgcgggaggtaccatgaatacagatggatttaagctgtgcaatgaaaaataccgcagcctgattctgcctgtcctggaggaaaatcatttgaaggcagaagactgtatcaaggtttgcgttgccgccagcggaattgattccaaaaggcaggaagaggaatgcagaagatcttttatggaaatggggtttaaacaggaaagcataacagtccataatgattgtgaaatttttcttcatatgtcctccggaccggccattgtgctggtaagcggtaccggctccatcgcatttgcaagaggggaatccggggagattgttcgctgcggaggctggggacatgtactcagtgatgagggaagcggttttcacatggggatgaaggtaataagagcggctgccaatcatattgacggaaggcagaagtgtcctgtgctgtatcagttgttttcagagaaaagcggcttaacaacattagatgagatcaatggttttgtcaatgacaggcttatggagaagtcggaaattgcctcttatgcaatccttgcagaaaaggcctgtgatatgggtgaggaagcaggatcagagattcttaaggagtgcagggatgaactgctgactcttgtcagagatgtttattataaggccggactttacaagtatgagggagaaaagcctgtggaattatggttctggggaagtgtgctgttaaaaaataagataatgggaacggaattgtctttagtcattcatagtgaatttcccaggatcatcatgaaacgtcccgcattctcagcgctggatacggctttgatactggccaaaggttaagcgttagatgccttggctgtgacgaaaggcggaaattaaaacaagcatgaaacatatcggttttcccggtaatttttcatgcttgtttttttcagaatcttaaatttgttctaacagtccttatagtaattatactgatatttcacatcaaatggaatcccgcattcttccggattttttgcaatccgtttcttgttttcatcattttccatgatgttaatggtctgataaattccgtcaaccaccttggaaaactttgatgcaaggattcctgcggccatctcatcagtcccccagccggtcagatgccggagcggtccatgatatttaccatggccgtaaaggtggtatcgttaaagcatatgtcaaagtcatctcccggccggtttaatatcctgcggatgcttaacagccccaggcctccatcctgtttgctggacaaaagctttcctccgctttctctgatctggccgttgtaggaattttccgcaagcatcatgagatgatcctgcatccaccttgcctgcaaatggataaagcggttttccttaagctttaagcaggcttccatggagttttccataagattgccgatgacaatgcaaagagttaagtcatcgattgggatgtgggcggatatatccagacttgccacgaattcgatctggttttcctggcagcgggtgccgtattcctgaaggacctggttgacggcaggattttcacagtaattttgctcttttggggtatctaactccttgtttagatcaagtaagtattttctctgctgatctttgtccatatggagaagggcgtggatatggtgcctgaaatcgtggcggatgatccgaagctcatctgcatgttccagcatctggttgtaatgctctctctgctttccgatgagctgcctggcaaatataagctcttcctctgttttctttctggatacagcttccagggtgccgtccaggatcatgacataaagcaccaggatcatggtgcagaaggcaagatagaaaaccacatcttcaaaccctctttttgcaagggattctctggaaaagatggtggaggtgccaaacagggaaatggccagggaaatagccggatacgcggcaaggagcagatgggagcgtctggacagctggataaaaagctgaccggtcctatcctttagccagtaacggacaaaaatataaaatccgcaggcggacaggaaggaaacgatgacgcagatctgactgtaggaaaggaatatggattttcccaaaaccgaggcggcaaactcgtttaatgacatggataagactgcaaaaagccaggcggataagtaaagaaataccttttttatcagctctccgttaaaaaatatgagaagaaggagaaaaaagaggcaggagaagatcccctggacgaagagaaacaccggttccctgatgtgaaacagagattggagggataccatgatgacccagagataaacggatactgccgcgatgttttcccggttcttcctttttggctccagacagacaaaaataggcatcatgcggactgccagattgatcagatttaatataacattacatgctgcttcgttcatggctgcctcacttcaattgaaaatgatagtaaacgtatttgcattccttgtaaaaattgcgggaaacagggaccatatccccgtttgtcatcacaaagcccgtggcttccaaagcttccacgtggttcaagtttacaatatagctttggtggcagcggagaaagcaggtctgaggctttaattcctcctgaagctcattgagcttttggtggatggaaagaacctccccgtttttaaggacaatgtagacccggtgcagcctgttttcaaagtacaggatccggcttagcttaagctccatgggaacccggttatgtatgatggaaatcgcagcttccctggatttaaagttttgttccatgacccgttttaaggtttcctcaaaatccttttccgccaggggctttaagacaaagcctgaagcattgacccggtaaccgtctacggcggattctaaggatgaggtgatgaatatgattacaggagcttctttctttttcaccagccttttggcggcttcaatgccggtcatgtcaggcatgatgacatccagaagatagatgtcataggtttcttccgcggaaagcaatgttccggcggtttcaaaatcatcaatctgagcatccatatcatgctttttatagtagtcgcgcacaaagtcaagaatcctcttcctgtcctctctgctgtcgtcacagatggcaatacgcagcatagaaaagtccctccgatctcattccattttattgagatttttcagagaagtcaagcggagagaaagaatctgcatatttggtgggaaatcggcagaatcggttgtgtgccctgccctgtgaatgtgttaaactggattcataaaagaattttcatataaaaacaggaggggttttttatgggagcaaatgttgttgttactgctattgttatcatttatctgctgctcatgctgtggatcggttggtattcatcctccaagatttctaccagtacagactttctggtggctggacgccgccttgggccgcttctcatggccggaacgctggctgctacggaaatcggcgggggaagttcccttggagtggtgcagaacgggatgtcaggctttggactcagtgcttcctggtacataatcaccatggggatcgcatttgccattttaagctttattgcgccccggttcagggctgcaacggttaagacggtaccggaatatttccgaaggcgttataataagtcctgcggcatcattacggctgttatcatgcttttgcccctggtagggcttacggcgggacagtttattgcatcagcggttattttgtccaccatgctgggcatagattaccaggtggcagtcatcatcgtggcggtagtggtaacggtctactccattatgggaggcttatggagtgttaccctgacggactttgtccaggtgtttctcattgttatcggaatgatcattgcagtaccttttgcgctccggtttgcaggaggctgggaaaatgtgacggctaatattccggagggaaccttaagcatgttccagggctatgatttattcggaatcatttcccttatcatcatgtacacagctacattctccgtggggcaggaggcggtatcccgtttttatgcggccaaggatgagaaggcagcaaaaggcggagcctggctggcagcccttatcaacttcatctatgcctttattcccacaattctgggagtcattaccctggcactgatgaatatggggaaatttaattctgagcagtttgcagaggtgggagccagatatgcgcttccgatcctggcaatcaacaccatgccagcagtggtctgcggacttttgttttccggcattatctcagcaaccatgtcaagttcggattccgatcttttgggagcagggtccatcttctccaatgatatttataaggccgtgttaaagccggatgcttccagccagtctgtcatgagagtcacaaaaatcgttatgtgtctggtaggcgtggcctccatgttcattgccctgtttaatacccagagcatcgtatccattctcatgttttgctttacccttcgggctgcaggctcgttcttcccttatgttatggggcattactggaaaaaggcgtcatcagcgggaaccattgcttctctcatagcaggaaccattgtggtagtatatttagagcatatttccggaggcgtgctgtttggagtcaaattcagccagcccattataccggggctgatcgcgggctgattggatttattattttctcctttgccatgccgcctaagaatgagactacggagctggtcccggaggaggatgactgatcaccttgtcagataagcggatattttctataaggggattgaggcagaaaactaaagaaatagaatatttcagcagggaaagagggggctgccacactaagtgattagtgtgcagcttcttttttgatgcgtccaacgggtgtacgttctataaggtgaaagtccggaaatacgaccggcagcagaaaggatataggcaggacccgcccatcgtaaggtgggatttaaagcggttactcagcctcttggtttttcttatggattgtatcctttaatcagcgaaaggccgtggatatagtgctgctccagaagctgggaggcaaggtcaaattggccggagctgtaggcattgacaatatccccgtgctgcttggtggagcaggaccggtcttccgctgtgcggatagcaaactttatcagcaggaaacggagaagattgtatcttttgtaggtctcttttaagaactgattgccgcagaagtcaaaaaatgacttatgaaaatggaagtctgcgtcaaagtaggcatcatcatccggagcaattgtctgcttttttaaatattccttcaaatgctttgtcacttccctgtcagtacccttggcaacggtcattttgagagctacacaggagatagccgcaatgaattcattgatttctgtcgcatatccatagtcaaagctgatcacctgggcgcctgttttagtaacctcttttaccaggccatcctgataaagcttgttgatggtatcccgcaccggtgtggaggaaactaaaaagcgttcctgcagttctctgtttgttattttgcttcccagaggaatggttccgctcatgatctcattttttaggatattgtatatctgttcgcttaaggtcattttcacaagagtactcattatcatcttctccttcctgcttgtcttaattacttgtagtttacatcttactataaatctcttttaaaagcaataatagggacaattgttggccgggcttgtctatatatttcccacaaccgcagaaatataaaaaatgttaaaaaaaaatattgacaaaatgccttttagttgtataataaacctaacacatatgatgcatcatacatcatgcatcacaaaacggacttgaaggtagaaagcaaaaactaaatatgtaaaggaggatagggaaatgcatctatttgaatggctggtgttttacatcgtaaagattgtaacggcacttaataaactgttgtggggcgacatgtttattctggaattttcaaatggtgaaacccagttcggcatatcattgctggtaatcctgctgattcccgcaggactttatttcaccgttaaaacaagattcctgccgttccggctttttcctgaaatgattcgggcgactttgaggaaaaaaaagggagaggatcagaattccatctctggtcttcaggcattgatcatcgccacggccacccgcgtgggtatggggaacctggcaggcgtggtagcggccatttcctttggcggcgcaggcgcagtattctggatgtgggtgactgccattataggctcgtctacttcattcattgaatcaacgctggcgcagatttacaaagaaaaggatcctctctatggaggatacagaggcggacctgcctatttcatgaaccggatccggtttattacaaaggtgaagcatgaagatatctttgtaaaggatgtaaagaaggaagcagagtatgtggcaatggacggcaacacctattacataaaaggatgcaagtgcacattccttggaattgcgtttgcgctctctggtctgctttgctgggccggtatcagccaggtaatcggaaattcggtttccactgcctttaaaaatgcatttggcattccccagatcaccacgacagtggttctggttgcggtttccgcatgcattgtgctccgtaagaatgccacagtgaaggtactggataaggttgtgccgattatggcatgcgcttatattgcaattacgcttttcattattgccaggaatatcgttcatcttccggctgtgtttgacagcatcttttcccaggcatttggacttaagcctatggtaggaggaggaatgggagccgttgttatgaacggagtaaagcggggacttttttcaaatgaggccggaagcggctccgcccctgtgcagcagcggctgccgaggtggatcatccggtaacgcaggggctgattcagtctctgggtgttttcattgataccctggcaatctgcagctgttccgcatttctgatgcttttggcaccggctgaggttatcagcggattagagggaatggatcttttgcagggagctatgaactatcacctgggtagattcggagttatttttatcgcgattatcctgtttctgttcagcttttccacatttattggcattctgtactatgcgcgcagcaatgtggcttatattttcaaggatacatgggcagctcagacaggatataagatttttgcactggtgatgctgtttgtcggcggaatcgctgcatatagctttgtgtgggatttaggagaccttggtgtagggcttatgaccattttcaatatgctggcaatcattcccttatcaggccaggccattgcatcccttaaggattacgaaaagaattttttaattaaaaaaaataaaaatataaatattttgcaggaggaatagtaatggatatgatgaaatttgcaccggagcctttcaaaatcaagatggtagagcctatgggcaacttaaacaaagaagagagaaaagaagccatcaggacagcaggatataatacgttcctgttaaaatcagaggaatgttttattgaccttctgacagattccggaacaaatgcaatgagtgacagacagtgggcaggactgatgctgggtgacgaagcttacggcggatccagaaacttttaccatttagaggagactgtgcgcgaactctttggattcaaatatgttgttcctactcatcagggacgcggcgcagagaacattctgtcttctcttaccattaagccgggagactatgtacctggtaacatgtatttcaccacaacccggttccatcaggaacacaatggagctactttccgagacgtggttattgacgaagcccatgatccaggcgcaattctggacttcaagggcaatgtggacttaaataagttccaggctctcattgacgaagtcggtgcagacaggatcccatatatctgccttgcagtcactgtaaacctggcaggcggacagccggtttccatggctaacattaaggctgtgtctgagatggctcataagtatggcattaaggtaatgttcgatgccaccagatgtgtggagaacgcatatttcatcaagacaagagaaaaaggctatgaggataagaccattaaggagattgttcacgaattgttctcctacggcgatggctgtaccatgtccggaaaaaaagactgcctgaccaatatcggcggcttcctgtgcatgaatgataaagatttatatatccgtgcaactggaatggtcgtacagtatgaaggcatgcctacctacggcggaatggcaggaagagatatggaggccatggcaattggccttagagagtcaatggaatacaactacatcagccaccgcgtaaatcagatccgttaccttggggaaaagctggacgctgcaggagttcctatggttaagcccagcggcggtcatgcaattttcgtagatgcccgtgcattcttagatcatctggatcagaaaacggacttcccggctcaggctctggcagcagctgtttatgagttctccggtgtcagaaccatggaacgcggcattgtctccgcaggaagagacattaagacaggagagaaccatgtgccgaagctggagacaatccgtctgaccattccgagaagagtttatacatatgcacatctggactatgttgctgaagcaataatccagctgtatcagatgaggcatgacatcagcggtcttaaatgggtatatgagccagaagttctgcgcttctttaccggacgctttgaacctaagaatggagagttaattaaaggattttaaagcttggaataaaacagacagcttgaaaatgaagtgtgtctgaaaaaagataaaagtataggatataggaagctgtgaaataagagaaaatgctgtttttggcccgggcagggccggaaacagcattttctcttatatggggcagcagcagggccggtttgttttacaaaagccggctcatcaatatttacagcagatccatcagctttctaaggccatccctggtatcatcagccgcgctcagcttagagtaggaggcagccttttggaaggcctggaaggacttcacatcctctgtgaggaagttatggaacagcatgtcaaagagaaccaggatgaggatctccctggaaatggtgttgctgctgtggagcaggtctgtttttgggaccagaagtgttatgttcgcatagggagagcagagggacttttcgtaattggtgacaagcagaatgctgctcccgtttttcttaaagtcagccaggatggaggaaagctgcttgtgattgccggaaagggagatggtgataaaaaggtcgctttccctggacaggctctgatacagctttagggtatcataattggtcagggcctggaccgtaagtccaatggtcatgaatttgtgggcaatgatttctgctacattctggttgaaattcaggccaacgataaaaatacgctgggattttagcataagctccctggcatggttgatgtccgaagggtttgtgagattaaacaggctgtccaaaagcatcttgttatcgttaagcagagtggagtagtcggaatgattgacggaagaagaacttttgtcgatctccttctgcatggtatattttaactcattaagcccggagtatcctactttctgagcaaagcggataatgctggcatccgatgtcccgatttcctttgccagctcctgggcgctcagttcaatgaatttggccgtggacttcttaatatactggacgattttccagtcagtcttggtaaactggtttgacataccgtcaatccgggccattaatgtaaaaagttcatagttctcagtcatttgttatacagcctttctttcactcttcccggaaagggaagcgtgttgttatttctgtagcacttctgtagtgaatttcaaaataagtatatcatattttaaaatcaaaatacaatattccagggataaaaaagttataattacaagaaaagtagtaaaatacattattttatatgtacaaatatcataaatacaatattgacattaaaaatgtagtatgctacaatttcaattatcaagggtcacatcataagaaatggaggtacgaaatggaaaagccgcagatattgcttttgacccacggaggctggggaatggcgctgacggagagccttaagatgattatgggaagcgtggattttgtccatgagatcccgttaacaccggaagtgacgtttgccgaatattacgcccttgtggagagttacgcagccgggatgccggagggatctttgatccttactgacgtttttggaggaaccactaccaatgcaggtgcaaaaatcggaaaagagcggaacattaaggtgatttcaggccttaatgcacctcttatgattgaggcctgcacacagatccagtacacggggacttgtaactttgatgtggtattaaaacagggacaggcttcggtcatggacgtggtgagtcagatcatggaatccatggaaagaaaggagaattaggaaatatggcagaaatcgtattatgcaggatcgacagcaggctgattcacggacaggtcatgacaaaatgggtcaaccagtcccaggcaaataaaattgttgtggtcagcgacagccttgcagctgatgaattcatgctggagatttacttaatgtccgctcctgcaggggttaaggtagaatgctacagcaaggcggatgcagttaaaaactggaaggaaaaccagtttggaaacggacgggtccttttgctacttcctgatctgggaagcatgaaggaagtatatgaaggagggattgaagttacggacattcaggtgggaggccttgggggagcgcctaaccgtaaggtggtatttcagaatatcaccttggatgatgaggatgtgaaaaagctggtttatcttcaggaagcgggtgtgaagatcatcttccagaccattccggaggatgttcctcaaaatttggatgggatattgaaaaaatacaataactaaggagggtatgacatgagtgtgttgatgttagctgtatgtatggggttctattactggttctgccgtttgagatttgggtacaccttttcttccatgctgcttcagccggtagtgatcggggtttttgtaggcttgctcaccggaaatatgcctttggccatgaagatcggggcagggcttcagctggtttatctgggagttacgtccacgccgggaggcaatgttccaagtgatccggcccttgcaggctgtattgccattcctttgggggtcatgtccaatatgacgccggaggttgccattgccctggcaattccctttggtgttatcggcgtatttgtagaccagttaagaaggactaccaatgcggtttgggtacatatggcggaccgttatgcagagaaggcggatacaaaagggattttgagggcggcttttctctatcccgccattgcaggcctgatcatccgttttccaatcgtatttgccattgactatttcggcgtaacagccgtggaacagctgatcaccatccttccccggtggctcatgcattcctttgagatcatgggaggcatccttccggctctcggctttgccatcaccctgtcggtcatcgggaaaaaggcactggtgccgttctttatcgttggattctttgcagtcatgtatttgaagcttgacaccatggcagtggcgatctttgccacctgcatggcattgcttttaggtttattccagttaaaggaggaggcagtttaagatgggagagcagacacaggtaaaaaagcttacaaaaaaagatattacaaaatccatgtggatttattatgccggcgcggaactttccaattcctatgagcgtttgcagagtctggtattctgtgcatccatgacgccggttttaaaaaagctttacagcacggatgaagaattgagcgcagccttaaaacgccacctggttttctttaacacagaggggatcttcggagcgatcatccaggggattgccatttccatggaagagcagaaggccaatggggaaaatgtgaccgatgaagccataacaggcattaagacaggacttatgggccctattgccgggatgggagatgccatcgtatgggcggccatcatgcctattatcatttccatcttcctgccctttgcaagcagcggatcagctttgggcggcatcatgcctctgatcctgtatccggccatttccattgcaattgcctacggcctgatccacaacggatataccctgggcaaaaagtccgtcatgtccctgctccacggcgggaagatgaaatccatcatttttacggccaatgtcatcggtcttaccatgatgggggcattatctgcaagctatgtaaacatcaccactccgctgaaatttgaatttgtcagcggaacccagatcgtggtccaggatatattaaataccatagcccctggcttactgcctttggcggccgtatttaccatctatacttatttaaggaaaaaggggccttactataacaggattctgcttacggttgtggcagtggctgtcatcgcttccctgcttggcatcctgtaagagtcactaaggagtatgaatatggaaaacatatatagcagaaacggcttacaggccgtgatcaatgcttccgggagaatgaccaagctgggcgtttctaccatttcaaaaggggtgggggaagcgctggtggaggcagctggaaattacgtggtgattgacgatctctatgcatgggcaggaaggaagatcggaagcatgatcgggatagaggatgcctgcgttacttcaagcgcttctgcgggcattgccctggcagtggcttccctgatctgcaggggcaatcttcaaaaggtaaaacatctttatgatattctgccccttgagcctaaaagagaagtgattctcttaaaggggcagaatgtggacttcggcgcccccattgcccagatgatccaggttggaggaggaaccattaaagaggccggctatgccaacggctctacggccgatgatatagaacaggctgtgacagaacgcacgctggcggtggttttcgtcaaatcccatcactgcgtccaaaaggagatggtggatgcggaaacagtgatccgtctggcaaaccgcctgggaatcccctgcatcgtagatgcggccgcggaagaggatttaagggtctacgccggcctgggagccgacttcgtatgctacagcggagcaaaggccattgaagggccgaccagcggatttgcggcctgcaagacaaaagagctggcagatcatatgaggcttcagtacaagggcatcgggcgcaccatgaaggtggggaaagaatgtaccatgggccttgtgaaagccattgaggaatatctggccggagaaaaaacaagccctgtgacaaaggaagaactggaagcgtttgcggcccgtgtaggggagatacggggctgtaaaacatccatgattaaggatgaggccggaagagaaatataccgctgcaggatcgaatttgacccggagctttacggcatggatgcaaagactttggtagagaagctgaaagagggaactgtggctgtctttaccagggactatcaggctaacttaggttccatcgcagttgatcccaggcccttaaacagcgtggctgagctgaatatgatccatgaaaggcttgtaaaaatccagcagtcggcaaaggaaggaatgtaaaggatggaaaaactgaatttttataaaggaagggtttgtttaaactgcctgactaattccgtggaaaatgcaagggcaatctatgaggctgcacagggtcatgtggcggttggcattttatcggcggattatccggatgtggaaagcgctgtggaagatatgaagaaatatcaggcagcagtggacaacaatatttccgtaggactgggagcgggaaatccgggacagtggaaggcagtggcggaaatctccggtcagataaagccaaagcacatcaaccagacctttacggcaggcggatatacaagggcaaaggcaggggacggtccgtttataaattccatggtggctccctgcggaaagcctgggtatgtaaaaatttccaccggacctttgtgcaaggatctggagcctgccgtggtgcctgttaagacagccatcgccatggcaagggaacagggagccgattccttaaagtacttcccaatgggaggccttaaggtccgggaagagctggaggcagtggcaaaggcctgcaaagagaccggctttggcctggaacctacgggaggaattgaccttgagaactttaaggagatcttagaaattgcggtggatgcaggggtagagcttattattcctcatgtatattcttccatcattgataaagaaacaggagctaccaggataccggatgttctggttctttatgagatgataaaagaagtggtgagataagagaaaatgatcatgccgttttcagcagcggcctggctggaaacggcatgtttttgtgcatattgtacgaaatataacggcgttattgaataaatttgcaaatagacttctgcaatgatccgtgatatactgcgtttagaaaatagatttgtagtttgtgactggtaaggcaggcaagatctacaggattgtagtcacgtattctcgttatgtgatggtcctcgtagcttgtctttttttgttattgaaagggaatatgaagattgaaaaagttttgaacaataatatggtatccgcttacaattccgggggaaagaaatcattctgaagggtaaatccattggctttggaaagaaaaagggcgatgaggtggaccgtaagctggtggagcgggtatttgtacagaatgacaagcgggaagcccgtcattttgaggagtattttgcaaagcttccccaggaatactgggagatcagtgaacaaaccgtggattacgccaaaagtgagtttggaatgcagctggattcccggatcattcttccggtgtgcgaccatatcgccggtgctgcagaccgttacagaagcgggaccatcctgcgcaatgccatgctttgggaggggaagcggttttatcccaatgagtttaaggtggggctgtatgcggtggacttgatcaggagaaggcttaatatttccatggaagaggatgaagccatgttcctggcgttccattttgtttatggacagctgaaccgggcggagactgatgatttagaggttattacggaaattatcaaggatatcgtggatattgtggaagcttcttttcaggtaaaactgaatacggaatcctgggattacaggcgttttgtgactcacatacgttttttcgttcagcgcatgcttcagcataagcagtatgaggagactgacgaagagtggtatcagctgttaaaggacaaataccgcaggtcctataactgtattattaaaatagcaaattatatacatgaccggtattattatgaaatagaccgggaggaaatgatgtatctgatgattcacatagaaaaggttaccagagagctggtttaaaacagagggctgggattgttaccggacaggatttatggtccgggcaggaccctgcatggaaagtgggctgcaacggttgtttgaccggcaggctgcttttcggcagggtccttttattatatcacaggaaagtgtgcagacactttttaaccgaatcaagtagcgaaacggattgcgaatatccgcttaactgaatggtaaggcgttataagatagccggcagacgccttttcagatagataacaataaaaaactttaaaataagggggaaaatcatatggcattggattatgcaaagaccgcacaggccttgcttgacgaggttggcggagaaaaaaatgtaagcgggctgacccattgtatgacacgactgaggttcgtgctgaaagacagcgccattccaaaggattctgaagttgaaaaggtgccgggagtgatccgggtggtccgccagggcggacaataccagatcgtcatcggcaacgaggtaggcaatgtacacaaggagcttttaaagctgggacattttgaggagagcacagggggaacggatgaagggccaaaggagaatttattctcccgcatgtgcggctttgtagccggctgcatgactcctctgcttccggccatgctgggctgcggtatgatcaaggtggttctgacccttctcatgacctttgggctggtggataccacaggaagcacgtatgtgattttaaatgcagcaggcgacgcattcttttacttcatgcctgtgttgcttgcaatgacaacggcaaagcgccttggctccaacatttatctggcaatggttgtggccgcgcttcttatccatcccgatattacggctcttttgggccagggcaataccgcttatttcgggatcccggtcacatcggccgtgtattcctcttccgtacttccggtgcttctcatcgtacccattatgggctatattgagcggtttgcggataagatctgccccaacattgtaaaggtgtttttaaagcctttgattgtggtttttatttccatacccgttgctcttgttgtagttggtccgcttggaagcatccttggaaattatctggcttccggcatcagctttctgtatgacaaggccggctggcttacaattatgctgctttctgcggccatgccgtttatcgttatgacgggtatgcattatgctctgatcccgctgatgaccatcggtttcaccagcctgggctttgacgcaatcctgattattaccatgttctgctccaatctggcccagggcggcgcttccctggctgttgcggtcaaggcaaaggatgagaacgtgaaatccaccgcctctgccgccggtgtctctgccattgttgcaggcattacagagcctgccatgtacggtgtgaccttaaagtataaaactcctatgatcgcctctgtcattgctgccgctatttcaggactttatgcgggaattacccatttggtggcctattccttcggcggttctccctccagtttatccctgatccagatgatcggcggcggtggctttgggaatatgataaacggtgtgatcgccctggtggcttctgtgacacttgcctttatccttaccctgattctttataagccgggggaggcagacgggggagcggcatctgaatctgatgctgcttttgaagagaaaaaaccattggtggagaccattgaactggcaagccctcttgcgggaactgtgatttctttaacagaggtggaagatgcggtatttgcaggcggagtgctgggagaaggggcggcaattatcccgtcagagggaaaggtgtatgctcctgcggatggaaccatcagcgcggtgatcgacaccaggcatgcagtgggaatcaccacggataggggagcagaggttttgatccatgtgggccttgatacggtgcagctgaaaggagatggctttaccattcactgcaaggaaggagaccatgtgacaaagggaagtcttctgctggaatttgatatggaaaaaattaaggaagcgggattttcccttacgacccctgtgcttgtatccaatatgaacaattttgtaagcttaaagatctgcgataagaagcaggttgaggcgggagagaaactgttgaccattgtgtaagctcatcaagtagctaagaggattggaaatgtccgattgacacaaatcaagcaatgaagcggattgcaaatatctgcttgactcattttgaaagaggtgtgatatgtctgtattttctgaagattttttatggggaggagcagtagctgccaaccagtgtgaaggggcatggaatgaggcaggaaagggggtatcggctgcagatgtatgtacgggaggttcccatacaagatccaagcggatcacccgtaccatagaaccggacacatattaccccagccatgaagcaattgatttttatcaccattataaggaagacattgccctgtttgcggaaatgggctttaaggtattccgcttctccattgcatggaccaggattttccctacaggcatggaggaagagcctaatgaagccggtctggaattttatgacaaggtgattgaggagtgcttaagccatggaattgagcctcttataaccatatcccactatgaaatgccttttgcccttacggaaaagtacaatggctgggtttccagagagtgcatcggcctgtttgtgaaatatgctgaaaccctgttcaaacggtacaaggggaaggtgaaatactggctgacatttaacgagatcaatgcaggaacaatgccaatgggcggttttctttccttaggcattttaaatgagggaacaacggatttcaccaatcaagtggatattccccagctgcggttccagggacttcatcaccagttcgtagccagcgctctagcagtcaaggcaggacatgagatcgatccggacaacaagatcggctgtatgatctgccatattaccacctatcctttgacctgtaatcctgatgatatattagaggcccagaaaagggatcagattttgaaccggttctgtggcgatgtgcaggtaaggggagaataccccagctttatgaaccgttattttaaagaaaacgggatcaccgttcagatggagccaggggatttagaaataataaaagaaggctgtgtggattattataccttcagctattacatgtccaactgcgccaccgcttctccggaacaggcagcctcctccggcaatttaatgggaggggcgaaaaatccttacttagaatccagcgactggggttggcagatcgatcccaaagggcttcgctataccttaaatgagctttacggacgttaccgcatccctctcatggtggtggaaaacggtctgggggcttatgataagaaggaagaggacggaagcattccggatgactaccggatagattacttaaggaaacacattgagcagatgagggaagctgtggaggatggcgcagagcttatgggatacactccatggggctgtattgacttggtaagcgcctccacaggtgaaatggcaaagcgttacggcttcatttatgtggaaaaatacgatgatggaaccggggatttatccagaaagaaaaagaaatcctttgactggtataaaggggtgatcgaaaccaacggggaaaaactggattaaaaacagcaggcaagctgaaatagagagagggcatcttaaaattccgtatgaatcaggaactttaagatgtcctctttttgtggtactattaagtatatttttttacgaatgaaaaaccagggacggaaattattcccttatatttctttttgggattttatataatttagtcatgaacgtgggcagacagggggcattggatatggttaagatttttcttgcagaggatgaaaaaatagtccgtgagggtattaaaaatgggattccatgggaaaggtacggatttgaattcgcaggggaggcgccggatggagaactggcctatcctctcattttaaaatccaagccggacatcctgctgacagatatccgcatgccttttatggacgggcttgagctggccgagctggtaaaaaagcagcttccgggcatccgcatcatgtttttcagcggatatgatgattttgagtatgctaagcgggccataaagatcggtgcggcggattatcttcttaaacctgtaagcagcagccagcttttagaggccttggagcggatgagcgaagccattatccaggagagaagcgagaaagggtataagctggagtttttaaagcagcaggaggaaagaaaacggatggagcgggaccggctgtttgataccattgtatcaggaaaattaggtctccaggaaatccttttaaaggggcaggaacacagcttatctctcagcgctccggtctataacctgattttgttccaggcaaggccatcccatggacaggaacagtatacggatcagggagttatttttgatgagatggtaaaggaacagtttgaaggcagggcggaggcagtggtatttaaccggctgacggaagggtatgccattcttgtcatgggaaatgacttagaagatttggagaaaagggtggcagcgtgcttaaatcgtttgatccgccttgtggaatcctgcccgggtatggagtatttcggggggaccggcgttccggtccgcaggctcagtgagcttaaggcctgttttaaggcagctagccgggcatacgcctgccgttacatgctggaatacaaccagtttcttacggcagaggccgcagtacggcttcatgatgattcgggaagcctcagcctggaaggtctggatataacgaaactgggcagggacattgtccccaactttcttaaaaacggttctgttcctgaggtgaagtattttctggaggaatatttagaggcctgcggggataacttcaaatccctgatcttccggcagtatctgctagtggatatgtatctcgccgcggtaagctttgtcacccagcttgggtttgaaccggagcaggtgctgaaggaattcggagatgcagagaccataaagccctgggtgggatcggaagaagctgcggtaaaatacgccagggagatcttaacaaaggctgtcaccctccgcaccacctgttcccagaaaaagtatcgtctggttcttgacaaggccagggattatattggaaatcactttcaggatgaggatatttccttaaatgtggtgtcttccaccgtgaatataagccccaatcatttcagcaccatattcagccaggaaatgggcatcacctttgtggaatatttaacaaaggtgcggatggaggctgcgaaagagctgcttcttaagacagaccttcgtgcctcggagatcggatatcaggtgggatataaggatcctcactatttcagctacatatttaaaaagacacatggaattacgcccaaagcattccggtcaggaggcagaaatgaactgcaaacgtgattcgatcaaagcgaaaatacagtccatgcaggcaatcgtatttatcccggtcattattatgattgggatattgctgtatatgatggcatggcagaataagcagtaccggcagagcatccggaacttaaccatggccacggagttcaattttgactttaaatccaacatcgattataagatgtaccgcatcgtcatcggagcggacagctttgattccttaaatccttatgaggagctggaaaattcccgcaggctgtttgagcagctgaaggattccactccccaggaaaacagcaaaaaggggcttgacgggatcatcattctcataggcattctggaaaaaaggatcgaggacatccgcaccagcaatattatcggggattatgaccggaacatggagcggctggacaaggacatttatgtgatcaccgacttaatcgaagaaaccatgtcggattatatttacaatgaaacaaagactctggaatccatgcgccggaagctggattcccagacaaagcgggccattgccctctgtatcatggtttccgcttatatcattgtgtttttaatggcttccttttcttcctttggaaagaagatcacaaggcccattgaggagctgtgtgaatataccatggtccttgcaaacggcagtttaaaggccaatgcgcccaggagcaatatcagggagatccagatgttaagcgaccagtatgatcacatggtagtccgcattgtagagctgatcgaccacattaaggaggaacaggagttaaagagaaaggccgaattaaagcttctccaggcccagattaatcctcattttctttataacaccttagataccatcgtctggctggcagaggggaaacgacatcaggaggtggtggaaatgatcacagccctttcttcctttctccggatgggactgaacaacggccgtgattttatcaccgtcaggggagaggcggagcatgtgaacagctatctccagatccagcatttccgctatgaggatattctggattatgagatcgattttaaggagcagatcatggattactccatcttaaagctgaccctgcagcccattgtggagaatgccctttatcatgggatcaagaattgcaggaaaaagggttttctaaagatcaccggctggcaggaagaggggacatcctgttaaaggtggaggataacggcattggtatgaaaccggaagagcttgaaaaaatgcagaagctggtgagcaggggaggagaggatgttggccttcgggaaggctttggaatcgccaatgtggcggagcggatccggctgaatttcggggaagcctatgggctgcacattgaaagccagtacggagcggggacctcagtgactgtcaggattccggcttctttaaaggggaacagataaaaaaaccaacctttttccgaaaaaaaccaaccttgttccggaatgcccggcaaaagcgtaaaaaactcaaccctttacaaaagattttgcattgagaaaagggcatgcaatcgctatgatacaggtagttactaagaagagcaaacacgatatatcatttggagggaattgatatgaagaaaagattattgggcatgatgacggcggctgccatgaccgcagccatggtattatccggatgcagcggctctcagacagcggcaaccacagcagcgcctgccggcggggaaacaaaaacagaggctgctgcggagacgacagaggctgccaagacagaagctgcaaaggcagaggagaaaaaggaactgctggtggtaggcttttcccaggtaggtgcggagtctgactggagaacggcaaacaccgaatccatgaaatccacgtttacggaagcaaacgggtataagctgatattcgatgatgcgcagcagaagcaggaaaaccagttaaaggctgtcagaaactttatccagcaggatgtggactatattgttatcgcgccggttacggaaacaggctgggatacggttttgcaggaagcaaaggatgcaggaatcccggttatcattgttgaccgtatgatcgatgtttccgatgactctctttatactgcatgggtgggttccaatttccttcaggaaggatatgatgcggttgcctggcttgatgaatatttaaagaagaataaccgggcagacgatgacatcaacatcgtgaccctgcagggcaccatcggttcctccgcccagatcggccgtaccgacggcgtggaagaaaagatgaaggatcatcccaagtggaagatgttagagcgtcagacaggagaatttactcaggcaaagggacaggaggtcatggaatccttcttaaagacctatgatgacattgatgttgtgatcgctgaaaatgacaacatggcctttggagccattgacgccatcaaggcggcaggaaagacctgcgggccaaagggcgatatcatcatcatttcctttgacgcggttgcagctgcttttgattccatgattgccggggatatgaacgtatccgtagaatgcaacccgcttcacggtccccgtgtggctgaaatcattcagaagctggaaaagggtgaaaacgtagataagatcgcctatgtacaggaaggtgtgtacccggctgacacggctgctgaagaaaaaccgaagagggcatattgatcccaggggccttggtgccgtaaaaaagagcgaatctagagaaacaggtgcaaaaggatggaggatggcggttttcattcctcctctctgcaccttttttaatccctgaatttgccgttttaagcggggcggggaaggaaaggaagggtttctatgcccaataaaatcgtattagccatgcgaagcatttcaaaaacatttcctggcgtgaaggcccttgaccacgtggattttaccttaagaagcggagagatccatgctctcatgggagagaacggagcaggaaaatccactctcattaaggtccttacaggagtggaagagtttgaatcaggagaaatcaccattgaagggtttcaggggaacatcatcaaccattcccctcaggaagcacaggcccatgggatcagcacagtctaccaggaggtcaatctctgtccaaatttatctgtagcggaaaacttatttatcggcagggaaccaaagcgtgccggcatgattgactggaaaatcatgaataagagagcaaaggatctgctggaaagcctggatatccacatagacgtgaccagggccctggaaaactactccattgccttgcagcagatgtttgccattgccagggctgtggatatgtctgcaaaggtgctgatccttgacgaacccacatcttctcttgatgaccatgaggtggagaagctgtttaagctgatgaaccgcctgaaatcggaaggcgtggggatcatctttgtcactcatttcctggaacaggtgtatgaggtctgcgacaggatcacggttctcagaaacggcgccctggtaggagagtatgaaacggaaaagctgcccagagtccagctggtggccaagatgatgggaaaggattttgacgacctggctgccataaagaaaagcggggaagcaaaggaaacgtccggggaagtggtgatccatgccaaggggatcggaaagcaggggaccattaaaccttatgatcttatgatccgcaaaggggaagtgatcggccttacaggacttttaggctccgggcggtcggagcttgccagaagcctttacggtgcggataagccggacagcggagaattaacggtaaagggacgtccggtttccgtgacagcccctcttgatgccatgatggccggaatggcctatcttccggaaaacaggaaggaagaagggatcgtggcggatctatcggtgcgggagaacttaattctggctcttcaggcaaaaaagggaatgttccgtctccttggaagaaaggagcaggaggagcttgcagataagtatatagatcttttacagattaagacagctaacagggagacccctataaaaagcttaagcggaggaaaccagcaaaaggtgatcttaggaagatggcttcttacagacccggatttcctcatattagatgagcctaccagagggatcgatgtgggaaccaagacagagatccagaagctggtggtaaagctttctgaggaaggaaagtccgtgatgttcatttcctcggaggtagaggaaatgctgcgcacctgcagccgcatggcaatactccgggatggacagaaggtgggggaactggaggaaggcgagctggatcagaacaacattatgaaggcgatcgcaggaggtatggaagatgaataggatgacagtgattgtgaagaaaataacaggaacccggttattcctgcccctgttctgcctggtcctggtgcttctctcaaatctcatcaagacgcctaccttttttcaggtgaccataaaaaacggcgttttgtatggatacatcatcgatgtgatcaaccgggccagtgatctggtgatcctggccgtggggatgaccatggtggtggcggcttccggcggcacggacatttccgtgggagcagtcatgtctgtggcaggggccgtgtgctgctacatcctgtcagggggtctgcagacggtgaatgagttccagaatccttatatattaggcgtgctggcagcggcccttgcagggattttatgcggaggctttaacgggtttctggtggcaaagatgaagatccagccaatggtggcgaccctgatcctgtttacggcgggacggggtatggcgcagctgatcaccagggggcagatcacctacatccgggtggaatcctataagatgctgggagccagcattccgggaatccctattccaactcccgtattcgtggcccttttagtggtggtccttacctacgttttactaaaaaaaaccaccctggggctttatatccagacggtgggaatcaactccagggcttccagactcatggggatcaaatcctccatgatcatttttctttcctatgtattctgcggcctctgtgcaggcatatccggcctggtggcatcatcaaggatctattcggcagatgccaataatattggtcttaacctggagctggatgccatccttgctgtagccttgggaggcaacagcctgggagggggtaaattttccctccttggaagcgtgatcggagcttataccattcaggccctaagtaccaccttatacgccatgggggtttccccggaccagattcccgtctataaggcaatcgtggtggtagtcatagttgcccttcagtcaacggagcttaagaaaatggcaaaacggttccaaacaggctttgaagccggaaagaaggtggcgtaaatgaagaacagaggaaaaatggatggaaaggtattcctgctcatgatcaccatcgctctttttgtgggaatgtacatagccgggatcctgatttttaagagcaagggctttgcaaagccccaggtatttttaaatcttttcatctccaatgcaggactgatcgttattgcagcaggcatgaccatggtcatgatcacagggggaatcgacatttctgtaggttccgtagtagcccttacctgcatgatgctggcctggatgatggaaatcaagggaatcggagctgttcccgcccttttgacggttttggtcatgggccttgtctttggcctaatccagggattttttatcgcttacctaaaaatacagccctttattgtgaccctggcaggcatgttttttgccagaggcatgacggccatcataagccaggaaatgatcagcgtgaaaaatgagctgtttttaaaatgggcaaagagcaaaatcaacttaacctttctgggagggacccccaacaaaaagggagtgatcaattacccgtttctctatccaagcgttctcatcgccctgacggtgctggtgctggtatttgtggtgttaaagtatacgaaattcgggcggaccgtttacgcggtaggaggaaatgagcagtctgccctgatgatgggattaaatgtgaagcgcaccaagcttttggtttatgtggccaacggctttttatgtgccttaggcgggtttttattcagcttaaatacctgtgcaggctttgtggagcaggcaaagggctttgagatggaagccatcgcctcggcagttatcgggggacattgctgtcgggaggcgtgggaaatgttttcggcagtttgtttggggtgttaataaagggaaccatagagaccttcatcaccttccaggggactctttcctcctggtggaccaagattaccattgcggctttgctggcatttttcatactccttcaaagcctgtttgcaagggcaaaggaaaagtgagctcagacagggaaggatatggatcagcggcggcagccgcctggcgggattttatctgtcaggcagctgacgccgctttttcatttttcccgctcctttttgcgaaaagccaggtcaaaaggcaggattctgttgacataagcctttattccatataaagtaatcatacggaaagaagagtataacgtaaggcagaaaatttacattacggaggtataacagaaaagtgcgcttttgctggaagagtttatgaaaaaatttatcggaaacaaagcattttacaggatggtgctgacaatcgccattcccattatggtccaaaacgggatcaccaactttgtcagcctgctggataatattatggtgggcatggtaggaaccgagcagatgtccggcgttgccattgtgaaccagctgatctttgtttttaacatcagcatttttgggatcatatcaggtgcaggcattttcggagcccaattctatggctgcggaagacacgatggagtccggcatacgttccggtttaaaatcatctgctgtgcccttctggcggtggctgcggtggctgtgttctttttcttcggagaggatatgatcgccatgtatctccatggagagggcaacgaggcggagcttgccactgcgctgatgcacggaagacggtatatgcttgtcatgcttataggattggtgccctttgccctggagcaggcttatgtcagcaccttaagggaatgcgcagaaacagtagtgcccatgaaagccggaatcgtggctgtcctggtaaatcttgtgtttaattatatcctgatctttggaaagcttggagctccggtcctgggggtggtgggagccgcaattgcaaccgttatggccagatttgtggaagcagcgattatcataatctggacccacaggaatacaaaaaggaatccgtttattgaaggggcttataaaagcttttatataccggcaggccttgtggggaaaatctttgttaagggaacgcctctcattgtaaatgaagccctttgggcagccggagtggctactctcatgcagtgttattctgtgagaggactgatcgcggtggcaggccttaatatatccgccaccataggaaatgtatttaatgtggtttatcttgcccttggaagcgcggtctccattattgtggggcagcttttgggagccggaaaaatggaggaagccagggaaacggacaccaagctcatcgctttttccgttggttcctgtgtgctcataggaggactcttggcggtcatggcccccttatttcccatgatttacaacaccacggatgaggtcaggagcctggccgtctggtttatccgcatactggcactgtgtatgcccatgaatgcgtttatgaatgtggcctatttcaccctgcgctccggcggaaagacggtgatcacctttttgtttgacagcgtgttcatgtgggtggtcagcattccggttgcctataccttaagccggtataccgccattcccattgtgcccttgtattttatgtgccagatggtggagatcatcaaatgcatcgttggttttgtactggttaagaagggcgtgtggatacataatattgttttgggtcaggaagattaaagaagaagcttcgaagaagaagcttcttttttatatgccggaatattcttggcgtatctgcctggagaaacgccgttgattttgctgaaaaccttgacgaaatgggcataatccttaaaaccgcactcatagcaggtggcagtaatagaagttccctttaataagagggtacgtgcatactgtattcttctggtgatgatataattccaaagagaagttcctgtatattctttaaataaatgactcagtctggaacggctgatgttaacaaaatcagcgatcgtctgaatggagatatcactggttaagttggaatccacaaagctgatggtatcacggatgattttgggagaaatatctcccagatacatattattggaccgggcggctgtattggccagcaaaaggatgaacagcaggcaggccttcacccggagatcatagccaaaggccttctcattcaaagccgttatgatggtgtcggcgtaatgctcatattccgccatctgctctttgttcagatgataaaggcgttccggccttccgttgtggaaacagctgaaaagatctgtaacaggtgttgataagttgtccgcaaagctttccccgatgtggatcggaattctttcgtagggattgttatccttgataaacagtccgtggatatcattgggacatataaaggtcagacagcccggcgttaaatggtaagtgacgttattgataaagtaatctacatttccgcttttaaacagcatgatctcgtatgcgttattgtgcaaatgaagtgttcgttctgcgttctggcaggtgcggatatgtgatacaagcagctgttcaattggctgaatggtgatctcattcatgataaatctcctcctgtctgcaaataaaagtatgcaatataaataaaaatataagtttattaaaagaaaaaacagggtgatataacaatgaaagtcagtacaatatgacataaatatagcataaaaaccaatatccaaaaagctcctatgtgatattatgtaaaaaatgataaaccacaggaggacatcagggatggacatcactttaagaacgaggaaggatgcggttaaacttttcttggataccataagccctttaaagccattttacagtccttgtcatgcatttttgcacctgggaaatacaggcgtccattatggggaaaaatccgccagaatggaagggtttgccaggatcttatgggggcttggcccgctctggtcagctgacaacaaaaacctgcccaaagaggagcaggaggaaataagggagtggcttgagctttaccgggaagggatcatccatggcacaactccggaggatgaggaatattggggggatatatttgactatgaccagaagatggtggaggtggctgccgtggtatttgccatagccattaaccgggataagctatgggatcctttggaagaaagagaaaagaaaaacttatataactggctgcggcagatgaatgaacacgatatgccaaaaaacaactggcgttatttccggatccttaccaatatgatgttccggcttttggggctggaatgttccaaagaacgcttggaggaagattttggcctgatggaaagcttttacacaggagatggctggtattgcgacggcaatcccgggcaggtggattattatgtggcatttgccatccattattacggactgctttatgcaaagctgatggatggcatggaaccggagcggtgcaggctgttaagggaacggagcacacagttttacaatgactatgtgtactggtttgctaataacggagaggaaattccatttggaaggagcctgacctaccgctatgcccactgcggtccctttggagcaatggcctttgcagatcttgatgtggattatgggatacttaagaatttgactttaagaaatctggagtcctggatgaggcggccggtttttgaccattccggaattttaacgatcggctacggctatcccagcctttccatgagtgagtcctataatggctgcggctccccctactggtgtaataaggcctttttgattctgggccttaatgaggaccatccgttttggaaggcagagccacggaattatccatatgaaccgaaaaagcttctcattcatccccatatgctcataacccatgatcaatatggccatgcacaggcatatgtggctggacagcatttaaagcacaatcatggaggcggaccggaaaaatacgaaaaatttgtttattccaatcagtttggtttcagcgtctctaagggcaccggtctggcagagggagcttttgacaatacgctggccgtttcgctcaaaggagaaaaccggtattttatgaggtggggccagcatgatttctccataaatcaccagacccttacctccagatacagccccatacccggggtaaccatagaaagtaccgtgatcccgtgcttttcctggcatgtcaggatccataagatatcaaattctattcctgtggaagcggctgacggagggtttgccatccctcaggagaactgtttccaattggaaaaaggcaggaaatcaggcaaatttgaggcagaagatgtaaaagcggagggaaactccctgtttgcagtctttccatggggaatcagcgggatcataggtgaaacgggagggatgccggaactggtttccgcatttcccaataccaacctgctttataatcttacagtcattcccacggtcagggcagtttatgaggaagggacccatgttatggtaaccagtgtatttgcggataaatcccctgaggcagaaattctcatgaaggagaaaccccaggtagagattttggaaaagcagatccatgttatatataagggagagtgtgttaaggttttgctttaacatggtaaggaaaggagaaggagatgaatttatcacagcaggatagggattgggtatcatctgcccttgagaagataaccggcaaaatgatgcccgtaacagagcggacaaaggataaggtgccttatacagccattgacggagtatttgatgaccgttccggaagtgatgatatcgcctggtggacaaatggcttctggggaggcataatgtggcagcttttttccgtgacaggagaaccgctttataaggaaacagccataaagctggaggaaaagctggatgccgttctgatgaacccggagggcctggaccatgacaatggctttaaatggcttccaacggcagtggcccattaccggattgaccggaatcagaagtcccgtaacagagctttgctggcagcagacaatctggcaggaagattcaatctttccgggaatttcatccgggcgtggaacgactggggagaagatgaccacaggggttatgcaatcattgactgcatgatgaaccttccgctgctgtactgggccagtgaggtgacacaggatccaaggtttaagcagatcgcagaggctcacgccgtaacagcggggaaatactttgtaagggaagacggatcggtcagtcatattgtggagtttgacccgtttaccggggaaatgagaaaaacccacggcgggcagggatatggagaaggttcttcctggacaagaggtcagagctggggtctttatggctttgtactcagctacatccatacaggagaggtccattatttacatacggccagaaagattgtgcattactttatttccaatattccggaaaacggcctcattccggtggatttccggcagccggaaacctgcacatgggaagattcaacggcagcggccattgcagcctgcggtctgattgaaatcgccaaaaatacggaaggcagggacagccaggtctatcttaattgggctcttaagctgttaaaggcgttggagcaggagcggtgctgctgggatcataagacagataatcttcttaaaaagtgtaccgctgcctaccatgacaaaacccacgaattttccattatttatggggattattattttattgaagcagtatgtaagctttccggaaagggaatcttcatctggtaataaaaagaagggaacaggaggaaaaatatgaaaaggaaacagttattagcaggtttcatggcaatgatcatggcagccgggggatcacgggatgcagcagccagtccgcaggaaaatccggaggcaatgaaaaggtgaccattaaagtggctctttgggattattccaataccaagtattataagactatgtttgatgcgtttatggaaaagaaccctgacattacagtagagccggtggagttttccgcagatgagtatgataacaccattaccacgcagcttggaggaaagcaggattttgatgttgtgtttacaaagggaactccggcattaagcgccctgatcttacagggccatgtgcttgctttagatgatttcatggcacaggacgattccttcagcaaagatcattatttaggtttgattgaccagctgcagctggatggaaaaacctatggggttccattcagaaaagacaataacatgatattctacaacaaagacctttttgataaggctggagtcccctatccacaggatggaatgaccatgaaggaatatcatgaactggcagctgaaatgacaagcggaagcgggaatgaaaaggtatacggagcccacgtacatacatggcccagtaatgtttataattacgcacgacgaatcgaagcatttgatcagctggataaagaaagttatcaaaacttaaaaccgtattatgaagaaatattagccatgcaggatgaaggagttgttcaggattacggcgcgctcaaggcttccaatatccattattccggtgtgttttacaaccagcagacagccatgcttcagatcggttcctggttcatcaacatgtgtcttgaaaatgtaaaggattttaactggggctgctgcagcatacccaatgtagatgggatcggcaataccaatgccattggaggagtgactcctgttgccatcggtgcctatgcaaaacatccgcaagaggcatggaaattcatcaccagcgtatgcggagaggaaggagcggagcttcttgcccagacaggaatcgtaccgggctacaactctgaaaagatcagcgggatctttgattccatgcatgagacatatcccaatgcgcctgaaaaactgtcggaatacattgatgttgataaatatatggtagagcagcgcatggacaggctgacaaaggaaattgataatattttacaggaacagcacagcgcaatcatgaccaagagcgttactgtggatgaggggcttaaacagctttatgacagagtttcagaagcagaaaaacagtaaacagccggaaagtgccggcctgggaaaggaggaatctgtgagaaaggaacatgatccgaaaaaaaacaaaaagccgctggccagaaagaagactttggtggcatactcttttattcttcccaatttgatcggtttttttattttcacattaatacctattgtattctcactgcttttaagcttttgtgagtgggattcgggcaatcctatccgatttgtgggattaaaaaattttataacaatgtttacaaaagattcaagcttctggattgcactgaaaaacacactgtgttatactctggtaactgtgcctgttaccatggtatttgcattgtctctggcgatattgatgaacaaggagttaaaaggacgcgtatttttccgttccgttcttttctttccctatgtggcgtctcttgtggcagtagccgttgtatggatggccctgtttaatccggaccggggtcctgttaacagcattctcatggctttagggatgttaaaccctcccaggtgggcagcttccacgaagtgggccctgcccaccatcatcggccttacagtctggaaaagcatgggttattatatggtggtttatttagcggctctccagggagtttcaggagaattgtatgaagcggcgtctttagacggagccaatcaatggaaacagtttttacatattacctggccaagtgtgactcccaccacctttttcattctgatgatgcttatggtatccacctttaaatcctatgataccatgtatatcacaacccagggaggccctggggaggcgaccaaggtactggcctaccacatttataacagtgcattcatcagctcaaaattcggctatgccagtgcggtggccatggtattgttgggaattatcatgatggtaactctcatccagtttaagggtgaaaagaaattcacaagctatctgtaaggaggcagttttatgagcaggaatcaaatgaaagtaattgcctccggaggcaagaacgtgtttatttatgccgctcttattctgatggcggttgttatgctgatcccctttgcatggatgatatccgcatccttaaagctggagaaagatgtgttttcgtttcccattgtatggctgccccctaaaccccaatggggaaactatctggagatatggaaaaaggtcccgcttttgaccggtttcttaaatacagccaagttaacgctgtttactacggtccttcagattattacctccagctttgcagcctacgcctttgcgaagctggaatttaagggaagggatacgctgtttatgctgtatgtaatgaccatatccattccctggcaggtttatatggttccccagtataagcttatgacatggttagggctgacggacagccatcttgggataatcctgatgcatgcgtttactgctatgggggtattcctcatgagacagttttttatcggcattccgggggaactgttagaggcagccagaattgacgggttaagtgagtacggcatatgggcaaagctgatgcttcccttatcaaggcctgcagtggcaaccctttgcataacctcttttacctttgaatggaatgattttatgggccccttatttatctgtcgtcccagaaaaataaaaccatacagctgatgctgcggatgtttaatacccagtattcctctaactatgcacagatcatggcagcagccacagtagcgctgataccggtgctgatcctcttcgtattcctgcagagatattttgtggaaggggtcgcaagctccggtatcaaagggtaatgagaaaggagagacaatgaaatattcactatttacagtaagtgtgccggatatgacgccggaacaggcattatcaaagatgaaagaattggggtatgacggagtggactggagggtaacagatattcctgatgatcctgaaatcttaaaggaagagccctcttactggagaaacaatctttgcaccattgatattgaaaccattgataaaaaggcggaggaaataaaggctctcaccgaccggtacggaatctgcattcatgccctggccacctatttaaaatgttcggacagcggagacaggattgaacggtgtatggcagcggcaaaggccatgggctgcggacggatcagggtcaatgccccttcctatgacgggaaacggacttacggcgaattatttgaagaggcaacagcaggatttaagcaggttgaggagctggcaaaaaagcacggcgttaaggctgcttttgaaatgcatatgagaaccattaccccgtctgcaagcgcggcgtaccgtctggcctcacagtttgatcccaattatatcggcgtgatctatgatacaggaaatgtgatctatgaaggctttgaagaatacaagatggcttttgaaattttaggaccgtatctggatcagatccacgtaaaaaatgccaaatgggtgaaggaacctgtggatggaaaagaaaaatatcttcccacctgggctccgtttgcagaggggcatgcagactttgaaaggtgtttccgggctctgaaagaggttggctatgacggatttatcacatttgaggacttttcttctgcagacagttcagaagaaaagctgaaaagtgatattaattatatgaaaagacttgttgaaaccatagaatagcaggaagatttaagtctgagataagacagagggaaataaatgatcagaacatttcaaaccaataaaatcagggaaaccagggagctaagcggcagcttgtggaatttatccccgtgtgcaggggaacataaagatgaaaaatacagcgtagctgttccctgctgctgggagacggttccggatttatcaaattaccggggaacagggctcttttcaagaaccatggaggcagaaggcaacatcaggctggtatttaaaggtgtgagccataccgcaagggtatgcctggatggaagggtaatcggtgagcattataatgcttatactcccttttcttttatcgtaaaaaatgtctccaaaggggatcatttattggaggtgtatgcggataattccttccatgaaaacagtgctctgcacgtgcccaatgattatatgagctatggagggatcagcagaggagttgtattggaaactctggaagatgcttttattgagtttattcatgcagttcctgtccggctggaagagggctggaatacaaaagtattggtaaaaataaaaaatttatcagcggaagaaaaagggtatggactcataatccagctcaatggaaggcgtgttgtgattgatgaggccgtcattggtccggaagaggaaagactggttgaggctgatattttccccggggaggtggaaacctgggagatggaaaatcccaggctttatgagatccgcgggatccttacggaaaatgggagggaaattgacgatttgatcgaccggatcgggtaccgggagatcaaaacagaaggaaaggatatccttcttaatggcaggaagcttctcatcaagggcttctgccgccatgaagatcatcccatgttcgcctgtgcccttcctttttccgcaatgcagcaggatctgctgatcgccagggatttgggcgccaattccatccgtacctcccattatcccaatgatgagctttttctggatttatgtgatgaacagggaattctcgtatgggaagaaaatcatgccagagggctgactttggagcagatgaaaaatcccaactttgaggaacaggcggaacgctgtattgaagaaatgatcaccgcccatataaaccatccgtccgttatcatatggggaatcttaaatgaatgcgccagtgacacggaatatggctatgactgttataaaaagcagtatgatttgatcaaaagcctggatgatacacggccaagatcctctgccagctgtaaatttaaaacagatatctgtctgggacttcctgaaatcgtatcctacaacttatacccggagtggtaccatgatacgcctgtaggagattatgtggaggatatttaccattgggtccaggctgagagccaaggcagagacaagccgtttcttgtgactgagatcggagcaggtgcaatttacggatatcggtcccagaccatgtgcaagtggtctgaggaataccaggccaaagcattggagaaccagatccgggcagtattggatcaccgtgagatctgcggtatttatatctggcaattctgcgatgtccgggtcagtgatgaatggttcggcagcaggcccagaaccatgaacaataaggggatcgttgatgagttccgcagaaggaagatgtcctatgatgtggtcaaaggcctgtttcattcctatccggattataaggaaaggtctggagcttgaaaatgagaaatactctcaaaaaaaaccttgtattttaagcgggtttgtggtattataactatagttagtttaaactaactccgtgtgaatattctaacatcagactaaccctctgattgtatccttcatttgacccgtgaaggatcatgactcctgcaaaaaagccgctcctgttaccgcatgacagggccggcttttttgatgtgaatctaactggaaaataaaaaggtccggatacaaggtaaaagttgtaataaccaggacaatacgctataattgggtgagagttgagtttggaggaatgaaatgaaatctttaattatagcagaaaagccgtcggttgccagggatattgcccgggtgcttcattgtacaaaaaatcatgacggagtaatagaaggggagacttatgtggttacctgggggctgggccatctggtcacattggctgacccggaagattacgatcccaaatataaggaatggaaaatggaggatcttcccatgatgccggaccagttccggctggaagtcatcaaacagaccggaaagcagtaccgggtggtaaaagcccagatccaccgggcagatgtgggagaaatcatcattgctaccgatgccggacgggagggggagcttgtggccaggctgatcctggagaaggcagggaataaaaagccaataaaaaggctgtggatctcttccgtcacagacaaagccattaaagaaggatttgcaaaattaaaaaacggtcatgagtacgacaacttatacgatgctgccatgtgccgcgccgaggcggactggctggtgggcatcaacgccaccagggcgctgacctgtaagtacaatgccagcttaagctgcggccgggtacagactcccacccttgccatcatcgcaaggcgggaggaagaaatcaaaaattttgttccaaagccctattatgggataacggccaaatgtgccagtccggccctttcctttacctggcgggatgagaaatcaaaaagcttccgttcctttgacaaggaccgggtggaagccctttttgatcatatgaaggcaataggcgaaggagtgatcactgaggtgaaaagcgctccaaagaaaacggatccgcctcagctttatgatctgacagagcttcaaagggaagccaaccgccggtttaactattctgcaaaagagactttgaacatcatgcagaggctctatgaaaaccacaaggtcctgacttaccccagaacggattccaggtatttaagctcggatattgttccatcaataaaggaaaggctggaagcctgcggcgttgggccgtaccggaagctggccggaaggctggcaaaccagaaaatcaaggcagctccttcctttgtaaacgataagaaggtgacggaccatcatgccatcattccaacagagcagtttgtccagctggaccatatgactattgatgagcggaagatctatgatctggtggtccgcagatttttagctgtactgtatccgccctttgaatatgaacagacggaaattaccctggatttaggtggagagacacttgcggccaggggaaagaccgtgaaagcccagggctggaaggaagtttatgataatcaggatgaggaagaggaagagcaggaattaaaggagcagaatcttcctgccatgaaaaaaggggaccgtatcacagggctgactgtgaccatgacggaaggaaaaacaaagcctccggccccgtttcaggaagcgtcccttctcactgccatggaaaatccggtttcttatatggaaacaaaggacaaggacatggcgaaggccttgggagaaacaggggacttgggaccgtggctacaagagcggatatcattgaaaagctgttttccggctttcttttagaaaagcggggaaggatatttatctgacctccaaggccaggcagctccttaaccttgtgccagaagatttaaaaaaaccggagcttaccgcccaatgggagatgaaattatctgaaattgcaggaggaaaattaaagcgggccgcattcatgaaggacatcaggcagtactccggggaattgatccatcagatcaggtcaggggaaggcagctttaaccatgacaacttaaccagtcacaaatgcccggtctgcggaaagcggatgctggcagtaaaggggaaaaacagtgagatgcttgtttgccaggaccgggaatgcggtcacagggaggtggtctccaggaccagcaatgccagatgtccggtctgccataagaagctggagcttaagggaaaaggggatggacagatctttatctgcaaatgcggctataaggaaaagctctcttcctttaaagaaaggcgtgccagggaaggtgccggagtatccaaaagggatgtgtcaaagtatttgaacgaacagaaaaaggaagggagtcaacccattaattcagcctttgcagatgcctttgcaaagctgaacctgggaggaaacggggagaagcctgtcccttaaaaagccttataccggccttataatgagaggccatggagaggaaaccgggtctgctgctgccggtcaagcggcattccggataaggttatggatcctgtgggtaaggccatatgggtgtagggagaggatgtctcaagtatgtttgctgttttgaaatatacgtttgggacatcctttttttaaacttatagtaacagtatggtaaaaatttagtaaaattttactttgcttattgacggtggcagaaactgcaattataatgaaaattgaaaggtgaggatatagattatggctacaataaaagaaatttcgcagcttgcggatgtatccattgcaacggtgtcaagggtcttgaaccaggacgataccattgtggtgagcccggaagtgaaaaaaaggatatttagaattgcccacgaattaaaatatgtcccacccaggaggcgtcatacgcagaaagaaagaggaattgtcataggagtggctgactggcatattatccggaaggacagaaccaacatcaggctttcctccctggacgtgatcgtaaaatccatgtcagggaaaaatgatgtgcgttttgaacggctggataaaaataagccgggacagtacgacggtatcatggccttcggcgttttttctgaggaagagatggagtttttgcggatgcagagctattctattgtattcattaattcggatccaaaggattatgagtacgacagcattgttatggattttaataaggggatccatgaaatgctggattatctcatggaacggaaaaaatactgcagcgtcggctacataggaggcctttatgaggaaggccaggtaaagatcggttacaggaggctggaaggaatccaggcagcttttatgcagagaggcctttacaaagaagagaatttttacataggcgatatcagcagggaaagcggctatgagcaggcaaaacgggctgtggaatcaggccgtctgccggaagcggtgctcttaggaagcgaagaagtggcggaaggcgcattggaagcgttccaggatgcgggcctgcgtgtcccaaaggatgtggcagtggtcatctataaggatattgagaccctggaatccaaatggccgtcctatactaaggtccggatgtttcctgatatcgtatggcagacagcgatcaagcttctgctggaacagatccaggaaggccgtaaagacaatatgacaatttatctcccaacaaagcttgaagtcggggacagtgcgtgatgacccatgatcccaagaaccgatgaatcacggaaaaggagagcagtatgaaaaaaacagtttctgtattaatggcagcagcactttgtgcagcaatgatcggaggatgttctggcggcagccaaacaggagccacaaccgcagcagggacagaggcagcatcgcctgcggcaggagagaccacaaaggcggaggcaaaagctgagaacaagaagattgacaaactgaacgtatattttgttccttccagagaaccggaagagatcgtaaccgccacagagcctttaaaagacatgctgaagtcagagctgggaaaagaaggttatgatatcggtgaagtagtgatcacggtaggaaccagctacgaagcggttggagaagccctttctgcaggcactgcggatatcggcctgattcccggaggtacttatgtcctttatgatgatggggcagaagtaattcttacggccaccagagatgcactgagcaaaaactccgattctgcaaaggactggaatgacggaaaggccacggaaggcactacggaccaggcaacttcctaccgggctcttatcattgcaggtccttctgaaaaggggaaagcattgacagacaaggtaaacaagggcgaagcattgacctttgaggatttagacggagcaaactggagcgttatgtcatcctcctcaccggcaggatacatttacccatccttatggcttcaggataatttccagaaaaacatgttaaacctttcccatgcagtacagtctgattcctatggaagcgcatttgcaagacttgcttccggtcaggtggatgttctctgtacctatgcagatgcccgcagggactatgaggagaaatggaaatccgaatatggcagagccggctccatctgggaagaaacaggtgtcatcggtgtgactcctcccattttcaatgatacggtcagcgtgagcaagacttccaaaatcatggatgatgattttaaaaaggcagttcagaacgcatttatcaacatcggcaatacggatgagggcaaggaagtcattgccatctacagccataagggatataagccggcacagagttctgattacgataatgaacgtgcggcacagaagatgatcaaggaattaaatgcaaaataaataatacacacaggctgcggaggcgtcgtaaacggaaaacatttgcggcgcctcctctctctatcctgggaaatgaggaaaatatgattgaatttaatcaggtggacaaaaagtatcccaatggctttcatgccttaaaagatattaacctgaaaattgaacagggggaatttgtggcgatcatcggcctttccggtgcaggaaaatccacacttctccggaccatcaaccgcatgcatgacattacaggaggaaccttaaccgtgaatgggaccgatgtgatgcagttaaagggaaaggagttaaggcgtttccgccgcaggatcggcatgatctttcagtcctttaacctggtgaccaggaccctggtcattaacaatgttctcatgtcaaaggtgccggatctgccgtttctaaaggctttattgggcatttacccaaaagaggataagctgggagctttggaggctcttgacaaggtggggatccttgacaaggcctttgtccgtgcggatcagttgtccggaggccagcagcagagggttgctcttgcaagaaccctggcccagaatccccagatcatcctggcggatgagccggtggcttcccttgacccggtcactgcaaaacaagtcatgggtgatttcttaaggatcaacaaagaaatgaacattaccatcctgctaaacatccaccatgtggacttagcgctccaatatgccagccgggtcgtgggcataagggcgggacagatcgtgtacgacggccctgcttcggaagttacccaggatattttaaatgaaatatatgaaggaaaagaagaggaggcggcaggatgagtttctatgacaagatatttccgcccaggaaaatggtattgtccaacggaaagaccgtctttcggccgttttccaggcttcctctggcggcattgatcctggtgttcttaaccgtgctgtccgtaaaaatcaccggttttgatatgagggtcttagcagaaaggggtaatcagttctttgttattctgggaatgatggttcctcccgctttttcctacagctcccaggtgtggaagcccctgtttgacaccattaaaatgtctcttcttgggacagtgacaggggcggtgctggtcattccctttgcaatggctgcttccaccaacattataaaaagccctgcagcggtcagcgtgatgaggctgttcttaagcgttgtaagaacccttcctaccctggtgactgctcttattgccacctatgtgttcggcctgggcactttggcaggaaccacggccattggggtttttacctttgcctatatggggaagattttatatgaagagatcgagactgccgatatgggagcctttgaagccatggaagccattggagcaaccaaggtccgggcctttgtaagcgccatcattcctcaggtgcttccttcctatatttccaatggattgttctgttttgagggaaatgtccgctatgcggccattttaggttatgtaggtgcaggcggcctggggctgatcctcaatgagaaattaggctggagggaataccccagtgtgggcatgattcttatcatgctgtttgttgccgtatttttgatcgagtcggtgagccgttactgccgccggaagctggtgtaggagggctgacagatgaataaacagattgaaaaagcatatgaagagcgcccaagaaacacggtttaccggatcaccgtgtccatcatcgtactggctctcattttatggtccggatctgccgtagacttttcaggcggtggtcttggggacttaaaatcgccggaaatattttaaacgggatatttcatcccgacaggaagctgctgtttaacctaaccgtacagggagttccctaccttcttttggaaacgatttgtattgcatttttagggacccttgtgggggcatttcttgccattcccttgtcctttttatctgcttccaatttgatgccggcccccattgcctatctcagccgtctggtgatcatggctgtgaggactattccggcctttgtatatggccttatgttcatacgtgtcagcggacccggcgcattcaccggacttttaaccatgtccgtctgttccatcggcatggtatcaaagatgtatattgaagccatagaagacttagacaccaggattttggaatccctggatgcctgcggctgcaacacatttcagaagatacggtatggaattctgcctcagctgattccaaatttcgcatcaacggtaatctaccggtttgacattaatttaagggatgcaacggttctggggctggtgggagccggaggcatcggcgcgcccctgatttttgccatgaattcctaccggtggaatgaggcgggagcgattctggtgggtctggtgatcctggttctcatcgtggagtacatatctaccaaaatccgcgtgaagctggccagggggtgatcagttggagaaacaggcaagaatttattacacttcagatgttcacggatatttatttcccacttcttacggggacagagaagagcggcctatgggtcttttaaactgcatctccaactttaagaaggacggaaatacccttgtttttgacggaggggatacgctccagggggctcccctggcaacctacatttcttctcagatggaggttgttccggaagcagacccaattgcaagggtatacaacgcggcaggctatgatgccgttgttccgggcaaccatgattttaatttcggctatgagcgccttgcggagtactttcaggcccttcagggagtctgcctttgtgccaatgccagggatttagaaggtaaggccaggatagtaaagagccatatctttaccctggagaacgggctccgcttgggagtgacaggagttgtaacggattatgtaaacgtatgggaacagccggagcacttggaaaagatccggatcaccgatgcgtttgaagcggcttcggaggaactgttacgattaaagagtcaggcggatgttaccgtatgcatttatcacggcggctatgagtgtgatcttgacaacggaacggttttaagtactacgggggaaaatgtgggctgccgcattttaagggagctggattatgacctccttttgactgcccaccagcacatgtctgttccaggaagagagctttatggaactcataccctgcagcttgcccctaatgccctgcagtacgcctgtgtggatatcagggtggaggatggaaaagtttctgtggattcctccatctgccctgccgggggagttcatggaaaagagccatacgaatccctgctgcctttggaagaggcggtgcaggaatggctggatgtggacatcggccgcttaaaagagccggttccggaaaagggtaagcttgagatggctcttaaagggtcagccattgcagatttttttaaccaggtccagctggaatattcgggagctgatatctcctgtgttggcctgggaaattcgtccatcagcctgccggaccatgtgaccatgcgggatctggtgcgggtgtatccgttttccaatacccttgtggtcctggaagtaaatgagggatcccttaagaaggccttggagcggtgcgccgaatactttactctaagagatggggagttaaagatttcagatgtattcttaaagccaaaggtggaacattataattatgactatttttccggcattacctttgaagtggacttaaaagaatctgtgggaaaccgggtgaaaaggatcctgtataggggagagcctcttgcaggccgttccttaagtctctgcatgagcgattaccgggccagcggtactggcggatatgaggtatacaaggaatgccggatattaaagcgtattaacaaagaggtcccacagctgtccctggattattttaagaggcatccggtggtaaatatagagaaaaacggcggtattattgtcgtttaaaaccggaaggtcctgtatataacctggggttatggaagctatggatattaggtataaagaaaacgttaaaatttcttgattttccaaaagtaaagtgatacactgctcttcaacaagagttatatcgaaaaaatgatgattgggacatatcatgactccgccccacattcctttacagagagcggcccggctggtggaaagggcgcaaaggaaagagcatgatctcgcccaggagttccgggctgaaagctttcccgacaggaaatgcgattaggtttggacggggatctttccgttaacaaagagctgctgcccgacaggcagtggattgaagtggctgcgtttgcgtggcaaacagagtggtaacgcggattgattgattcgtctctgcatcttttgatgcagggacgtttttttcggtttatcgattgttattaggaatgaaagttcttattaaaatggaaaaggagagagagtatgaatggtttaacaatgatgctgctggccgttgtggtattaggcggcgcctatttaatctatggcagatatcttgccaggacatgggggatcgatccgaaagcgaagactcctgcttttgaaatggaggatggagtggattatgttcctgctgataccaatgttgtttttggacatcagtttgcatcaattgcaggtgcaggccccataaacggaccgattcaggctgccatgtttggctggctgccggttatgctctggatactgctgggcggtgttttctttggagcagtacaggatttttcttctatgtatgcgtctgtaaagaacaaagggcgttccattggatacattattgaactttatataggaaaattgggaaaacagttattcctattatttacctggctgttttccatcctggtggtagctgcctttgcagatattgttgcgggaacctttaacggtttttctgccgatggtgcggcgattccggcaaatggtgccgttgccacgacttccctgctgtttatcgtatttgccgtggctcttggatatttcctgaaatacacaaaattcggaaaaatagtaaacacattgactgccatagtttttcttgtgctggccgttgggcttggccttgcttttccggtatatatcccccagagttcctggctgatttttgtattcttatatgtgctggttgcttgtgttacaccggtatgggcacttttacagcctcgtgattatctgaacagttatttgctcattgccatgattgtcggagctgtttttgggattttggtatacaatccttctatgaatctgccatcctttaccggattcaaactggttggtaccaatggaagcgtatcctatttgtttccgaccctgtttgttaccattgcctgcggagccgtatcagggttccattctctggtagcttcgggaactgcatcaaagcagatcaaaaatgagaaaaatattttacctgtttccttcggtgccatgctgctggaaagcctgttggcaattactgcgctgattgcagccggatttatagcaacaaaggaagggctgccggcaggcacgccaccccagctttttgccagggccatcgctgtgtttttaaccagcctgggtttgccggaatctgtgtgttatacgctcataactctgtccatatccgcgtttgcactgaccagtctggactctgtggcccgtgtggggcgtatcgcatttcaggaattttttactgatgattccatggaaccagagaaaaaaggttcgttgaataaatttctgacgaataaatatgtttctaccatcctgactctgctgctctgctatgctctgtcccaggcaggatatgccagtatctggccgctgtttggttccgccaatcagctcttgtccgcactggcattgatagcttgcgccgtatacttaaagaaaacaaaccgccagggctttatgctctgggggccaatggtcattatgttgggcgtgaccttcacagcgcttggattaaagattaaggaactgatcacagcactttccggacagtttgtatttggaaatgcgctgcagcttgtatttgcagtactcctgctcatactcggcgtgattgttgcttttgaaggaattaaaaagctgattggaaaagaagatgaggaagtagctaagacagggaaaaatgcattggctcagtaggagcttccgcaagagcgaaaaaagaatgttggcattgcttaaagttttcattaaaatcagcacactctcctctaaaaagggaagagtgtgctgatttttagtttcaattattacgagctaaatagaattgattctttttgtttgctcattgttattgtatatacaggccacctgaatagaagaaaggcagactttgtgcctgtgtaccgccactggtagtaaatcctaatacgatcgcaacctgagtacctgcggtaagcgggacgttcagtccggtggaggagcctgcccgggttacataagctccataggcagttccctgcgtatagggctgggttgccggtgtaattgtactggtgataattgtataatccgcgctgttcgatggggcagttgctattgccacatacaatgttacattggtagttggtgtaaatgctgcaactgtagcaaagtttgcataaattgactgaagtgttccatcgactggcattgtaaaggtataccagccgtctgctgtattgattgaaaaggtggttgcggatgtcagggttaacgttgttgcactttcaccatagccggttaaagaaatagctgatgatgcaccagaagagtttgtggcaggtgttgcatttacataacctgtcgcaaaaggaataatatttcctgatgcaaggccggctggcccggtatcgccggtaggcccggtatcaccggtaggtccggtaggtccggtgtccccggtaagcccgataggtccggtaggtccggtaggcccggtgtcaccagtaggcccagtgggtccggtatcgccggtaagtccgataggcccagtgggtccggtgtcaccagtaggtccggtgggcccagtaggtccagtgtcaccagcaggtccggtgggtccgatatcaccggtaagtccgataggtccggtgggcccagtgtcaccagtaggtccggtgggcccggtatcgccggtaagtccgatgggtccggtgggtccagtgtcgccagtaggcccagtgggtccagtgtcgccagtaggccctgtaggtccggtatcgccggtaagtccgatgggtccggtgggtcctgtgggtccggtatcaccggtaagcccgataggtccggtggacccagtatcgccggtaagtccgataggtccagtgtcaccagtaggcccggtatcgccagtaagtccgatgggcccggtaggcccggtatcaccagtaggtccggtgagcccggtgtcaccagtaggcccagtgggtccagtgtcgccagtaggccctgtaggtccggtatcgccggtaagtccagtgtcaccagcaggtccggtgggtccgatatcaccggtaagtccgataggtccggtgggcccagtgtcaccggttggtccggtgggcccggtatcgccggtaaatccgatgggtccggtgggtccagtgtcaccagtaggcccggtgtcgccggtaagtccgatgggtccggtaggcccggtgtcaccagtaggcccggtgggtccagtgtcgccagtaggcccagtgggtccggtatcgccggtaagtccgatgggtccggtgggtccagtgtcaccagtaggcccggtgggtccagtgtcgccagtaggcccattaggtccggtatcaccggtaggtccggtgggtccggtatcaccggtaagcccgataggtccggtgggcccagtatcgccggtaagtccgataggtccagtgtcaccagtaggcccggtatcgccagtaagtccgatgggcccggtatcaccagtaggtccggtgggcccagtatcgccagtaagtccgataggcccagtgggtccggtatcgcccgtaagaccgatgggcccagtgggtccggtgtcaccagtaggtccgatgggtccggtaggcccggtgggtccggtgtcgccggtaagaccgatgggcccggtgtcaccagtaggtccgatgggcccggtaggtccagtgtcaccagtaggcccggtgggtccggtgtcaccagtaggcccggtggggccagtatcaccggtaagaccgatgggcccagtggatccggtgtcaccagtaggtccgatgggcccggtaggtccagtgtcaccagtaggtccggtatcgccggtaaggccgataggtccagtatcaccagtaggcccggtgggcccagtattgccggtaagaccgataggtccggtgggcccggtgtcaccagtaggtccggtatcgccggtaggcccagtgtcaccagtaggtccgataggcccggtaggtccagtgtcaccagcaggcccggtgggcccagtatcaccggtaagtccgatggttccagtaggcccggtatcgccggtaggtccggtggggccagtatcaccggtaagaccgataggcccggtaggcccagtatcgccagtaggtccgatgggtccagtagatccggtatcgcccgttagcccgatgggtccagtaggcccagtgtcaccaataggtccgataggcccggtagatccagtgtcaccagcaggcccggtgggcccagtatcaccggtaagtccgatggttccagtaggcccggtatcgccggtaggtccggtaggcccagtatcgccggtaggtccgatgggtccagtatcgccggtaggcccagtgtcaccagcaggcccggtgggcccagtatcaccggtaagtccgatggttccagtaggcccggtatcgccggtaggtccgatgggtccagtatcgccggtaggcccagtgtcaccagcaggcccggtgggcccagtatcaccagtaggtccagtagcccctgtagatccaacaggccccgtagaaccggtaggcccagtagcaccaataggcccagtaggcccggtggcaccgataggtccggtaggcccggtggcaccaacagatccggtaggtccagtaataccggtagggccagtaggtccgataggccccgtgtcaccagcaggccccgtaggcccggcaggcccagtgggcccagtgataccggaagcgccggtaggtcccgtaggtccagtgggtccggtaggcccagtaggtccagtaatctcttctgtttcatcctcaacgacaaccagcgttcccctcagcggaacctgttgagaaaaatataccgttgatgtactaatgtttacaagagaaaaagtaacgggtggagctgtaacctcaataattccaactccatacacctctcctgtttttataggagaattacctattataaagtctccctgtgatgaggatatggcgaaagcagatccatttaaagatgctgacgactgtgttgctagccaccaatgaataacatatcttccagcctcaggaatagtaacagtgccagttgatggattatagctgatatttcctgaaagataaatgattgaatcaaagaggacatttgatccggttccgattgataaggcagcatttaagtcgatttgtagtgcggaattgctcattgtaattcctccccatattttactagtcaatataaaaacagcgcataataatgcctgctatatattttatgctgagaaatgggattaggaaacttttagtactttacatgttttcagagaatttccctttgtcttttcacagaagttataataaaagcgagttgggatattgaaaaatactgatttagaatagtataaaataagaggaatattcattgatgacgaataatagttgaggtggtaaaaatagactttaacccgaaagtgttataatttgaaagtggtttcggaccaaagattgggctgagaagcgacattttttaccctcctaaaataagcgaatataaaagtagatattggagatgaaataacagaaaattattaattaccccaaatgatgcttctatgtttcactgataccgcaagcctaaaaaggggtaagcctaaccaaagtcagtgttatgtttctataatgacttaccctattcctattaagcttttatagactaatgagattttgcacatcgagcacggctattaaaaccacatttagctgctgatggctgaatagccttaggagctatttctttatagatacctccacgatagaagccttagaaggacttttttacgagacgatattcaccatgttaaaaagtaatgatagcaacacgcccgtcctcagccatggcagaatgaattttttctaaaaattcatataacacttcaaattcatgattgatatcaattcgcaacgctttaatatatctttgacaggatttttttacttcattatttctatccttttccgaaataaatttcaaagcgtctttgataatttactggagctggcttgttgttgtaatgccagtacctttttttgattacgtgaataatggcaccatagacttctgaggaatgaggatcgtccgtaattggaaaagtttgtttgcatgaccgttaaaatttccgggctataacctaagcgctcaaacattactttgtccgcagcaattcgatggaatctccatcagtagcatacaagtgcccctttgagtttaaacatttaaatatctctaaagtatggccacagtgacctaagatggcatctaaatcataataaaagaatctggttttgctgtatttctgggtaccataaagcggacagtacagaatggtttccctgattgtggaagagattgcgggagaagtaaaaggcgcgaggatgcataaagtcaatgtaaataaacaactgaggttattgcattgcgttaaagtaatgagcattcctgttctgcctgttataagagaagaactttgagtttcgtactttacagaatttgttcaatggccataccacattagaaaagcgttctaccacggtacgcgaagcaaagttttcaacatagaggttttggctggtcaaatatgcaaacacagaggtattaatatgcagggcctctccgtcttttttgtattgatatatatgccaaaaatgtactatgatatagaacctgctgccccccgttctataaaatcgcctatttctgctataaattacagaggattaccatatggcaatcctctgataatagcatatagcaacttatattctaagcgattcgctctaccaatatgcgtgctcctaatcccgtggcgggaaagaagaaagtaattggtgcaacgagcgactgcatctgaagtgtcaggaggtctccggcggtgagtgtataatagtctgccattgcaaatgtggtcgttgtatcactggttgcctgcaaggactgttgcatggtggtttggggcgttccgttaatgacaaacgaggcaagaacatcttcatctgaggaactggctccagctataagcacgtcaatacggtatacgccgctctctacgattgtaatggtatttgctgttgtatagtcaacattgtctgatgccgtggtttgaatggtcataggaaccgtgaccggtgtggtggtcaacgctaaggttcccagctccgacatcaagcctccaaaagcactgactactccgccagttggacccgtaggtccggtatcgcccgtaagtccgatggggccagtaggtccagtatcaccggtaggtccagtgtcaccagtaggcccaatgtcgccagttggacccgtaggtccggtatcgcccgtaagtccgatgggcccggtaggtccagtatcgccagtaggtcctgtgggtccggtatcacctgtaagtccgatgggcccggtaggcccggtgttgccagtaggtccagtatcgcccgtaagtcctgtgggtccagtagggcccgtaggtccggtatcgcccgtaagtccgatgggcccggtaggtccagtattgccagtcggcccagttgggccggtatcgcccgtaagtccgatgggcccggtaggtccagtgtcaccagtcagcccgatgggtccagtaggcccggtatcgcccgtgagtccgatggttccggtaggtccagtgtcaccagtaggcccagtgtcaccggtcagtccaataggcccagtaggcccagtatcgccagtaggtccaatgggtccggtatcacccgtaagcccggtggggccggtaggtccagtatcaccggtaggcccaataggcccagtaggcccagtatcaccagtaggtccaatgggtccggtatcgccagtaggtccagtatcaccggtaagtccgatgggtccagtaggcccagtgtcaccggtaagtccgatgggtccagtaggcccagtatcaccggtcagtccgatgggcccggtatcaccggtcagtccgatgggcccggtatcaccagtaggtccagtgttaccggtaagtccgatgggaccggtaggcccagtatcgccagtagggccgatggggccggtatcacccgtaagcccgatgggtccagtaggcccagtatcaccggtaggtccaatgggtccggtatcgccagtaggtccagtatcaccggtcagtccgatgggtccagtaggcccagtatcaccggtcagtccgatgggcccggtatcaccagtaggtccagtgttaccggtaagtccgatgggaccggtaggcccagtatcgccagtagggccgatggggccggtatcacccgtaagcccggtggggccggtaggtccagtgtcaccggtcagtccaataggcccagtaggcccagtatcaccagtaggtccaatgggtccggtatcgccagtaggtccagtatcaccggtaagtccgatgggtccagtaggcccagtgtcaccggtcagtccgatgggcccggtatcaccagtaggtccagtgttaccggtaagtccgatggggccggtatcacccgtaagcccgatgggtccagtaggcccagtgtcaccggtcagtccaataggcccagtaggcccagtatcaccagtaggtccagtgtcaccggtaagtccgatgggcccagtaggcccagtatcaccggtaagtccaataggcccagtatcaccagtaggtccaatgggtccggtatcgccagtaggcccagtgtcaccggtcagtccaataggcccagtatcgccagtaggtccaatgggtccggtatcacccgtaagcccggtggggccggtaggtccagtatcaccggtaggcccaataggtccagtgtcgccggtcagcccaatgggtccggtaggcccagtgtcaccagtaggcccagtggtcccggtatcgccggtcagcccgatgggtccagtaggcccagtgtcaccggtcagtccaataggcccagtaggcccagtatcgccaataggtccaatgggtccggtatcgccagtaggtccagtgtcaccggtaagtccgatgggtccggtaggaccagtgtcaccagtgggtccggtatcacccgtgagcccgataggtccggtgggcccagtatcgccggtaagtccgataggtccagtgtcaccagtaggcccggtgggcccagtatcgccagtaagtccgataggcccagtgggtccggtatcgccagtaagaccgatgggcccagtgggtccggtgtcaccagtaggtccgatgggtccggtaggcccggtgtcaccagtaggcccggtgggtccgatgtcgccggtaagaccgatgggcccggtaggtccggtgtcaccagtaggtccagtgtcaccagcaggtccggtgggtccggtatcgccggtaagaccgatgggcccagtgggtccgatgtcaccagtaggtccagtgtcaccagcaggtccggtgggtccggtgtcaccagtaggcccggtgtcaccagcaggcccggtgggcccagtatcaccggtcagtccaataggtccagtatcaccagtaggtccaatgggtccggtatcacccgtaagcccggtgggtccggtaggtccagtatcaccggtaggcccaataggtccagtgtcgccggtcagcccaatgggtccggtaggcccagtgtcaccggtcagtccaataggcccagtaggcccagtatcgccaataggtccaatgggtccggtatcgccagtaggtccagtgtcaccggtaagtccgatgggtccggtaggaccagtgtcaccagtgggtccggtatcacccgtgagcccgataggtccggtgggcccagtatcgccggtaagtccgataggcccagtgggtccggtatcgccagtaagaccgatgggcccagtgggtccggtgtcaccagtaggtccgatgggtccggtaggcccggtgtcaccagtaggcccggtgggtccgatgtcgccggtaagaccgatgggcccggtaggtccggtgtcaccagtaggtccgatgggcccggtaggtccggtgtcaccagtaggcccggtgtcaccagtaggtccgatgggcccggtaggtccagtgtcaccagtaggtccggtatcgccggtaaggccgataggtccggtaggtccagtatcaccagtaggcccggtatcgccggtaggtccggtgtcaccagtaggtccagtatcaccggtcagtccaataggcccagtaggcccagtatcaccagtaggtccaatgggtccggtattgccagtaggtccagtatcaccggtcagtccaataggcccagtaggcccagtatcgccagtagatccaatgggtccggtatcgcccgtaggcccagtgtcaccggtaagtccgatgggcccagtaggcccagtgggtccggtaggcccggtgtcgccagtaggaccagtatcgcccgtaagtccgatgggtccagtgggtccagtatcgccagtaggcccagtatcgcccgtaagtccgatgggtccggtaggtccagtgtcaccagtaggcccagtgggtccggtatcgccagtaggtccaatgggtccggtaggtccagtaggcccagtaatctcttctgtttcaacctcaacaacaaccagcgttcccctcagcggaacctgttgagaaagatataccgttgatgtactaatgtttacaagagaaaaagtaacgggtggagctgtaacctcaataattccaactccatacacctctcctgtttttataggagaattacctattataaagtctccctgtgatgaggatatggcgaaagcagatccatttaaagatgctgacgactgtgttgctagccaccaatgaataacatatcttccagcctcaggaatagtaacagtgccagttgatggattatagctgatatttcctgaaagataaatgattgaatcaaagaggacatttgatccggttccaattgataaggcagcatttaagtcgatttgtagtgcggaattactcattctaattcctccccatattttactagtcaatataaaaaacagcgcataataatgcctgctatatattttatgctgagaaatgggattaggaaacttttggtactttacatgttttcagagaatttccctttgtttttacacagaagttatttcaataaaagcaagccggaatattgaaaggacatggaatagaatggtgtcagacaggttatgaataaacttgttaaggaaaataagaacatgaattacagcatatcctttcactgtaagcaaggcaagctcatggattgtataatcaaaaatagtcagatacagggcggaaaaaagaaaataaccaacctcaaatccagctgatccaatgttttatttcagtcccccgttgaaagaatatgcaattctaagtataatagcattattacatttaatgaaaaaagattaaaagaaccagggaggcattatgtgcatcagagtcatagtagtagataactcggaggaattattagttaaactgactcgtattttaaaggaaatagatggagttgagttatgcggcagctttaatgaagccattacagccatgcaatatgtgagagaaaattcgatagatatggtgttttcagatgtggtcatgccagacatcagcggaattactcttgctgctaagctctatgagcttcccaacccgccggaggtggtacttctttccggaattcccggtttttcgctggaggcatggaaaatccgggcttttggctttatcataaaaccctatacaaaaacgcagatagttaaaatgatcaatcaatatataatagaaagaagcagagtggtataaggctgagaaagatgttcggcggtaacagacaataaggaccataccggtttattgtcaaaggggtttttgcgttttttgcagcgcaaaggccctttaaaaattgttttaaattcaccgaaagccttgtatttccttagtttttgtattttaatggacgaacccagatgactatgatataatgttaagatagtgaaaaagagaacccttttttccataaggagaaagatatgaaagaaaagttcaaaataaagggacagctgaggacgtatatgcagtggccgctttatctgagcgcattgctgattgccgccaatacggtgatcggcgcagccagcacaaaagcgggcattatcatggcggtttttacacttctgtatataggtatagcagtctggctttatacttacagaagaagacttctgctgagtggccttgtggaattttctgcggaatattcctggatgcagaagcagctccttaccgatctggaaattccgtatgggatggcggatgaaaacggaaggattctctggggaaatacagtgttttcagaggtgttgggggaagaaaagcctctaaagcttacaagaaagaacatcatgaccatttttccggagataacaaaggaagtgttaaagcttaacgagggtacggctgttcttcatgccgcacgggatgaacggaaataccagatccgcttaaaggccatttatatgaaggattcaccggaatctattgttccatccattggcatggaggctgccgggcagatgcttgtggcaatctatctttttgatgaaacagagattcttacttataagcagatggtggatgaccagaagatggtggccggccttatttatctggataattatgatgaggctctggagagtgtggaagaggtacgacgttccctgcttactgccctcattgaccggaagatcaccaaatacatcaccaatatgaacgggatcgttaagaagctggaaaaggataaatattttattgccattaagcagtcctatattgcggaacttaaggagaaccgtttttccattttggaagaagtaaaaaccgtcaatatcggcaatgagatggcagtgaccttaagcattggccttggaatgaacggagacagctattaccggaattacgatttggcaagaatcgccattgatatggccctgggacggggaggcgaccaggcggtgattaaggatggtgaacggatccagtatttcggaggtaaggcccagcaggtagaaaaaaccacccgcgtaaaggcccgtgtaaaggctcatgcgctcagggagctgatggagacaaaggaccggctgttgatcatgggacaccgtttaacagatattgatgcctttggcgctgcggttggaatttaccgcattgcgacggccatggataaaaaggccaatgtcatcatcaatgaagtgactacctcggtccgccccatgctggaccgttttgtgggaaatcctgattacccggaggatttatttttaacaggagctaaagcagcagagctggtggacgccaatactcttttggtggtggtggatgtaaaccgtcccagcattaccgatgcgccggagcttcttcgtcttgtaaagaccattgtggttctggaccatcacagacagagcagtgagatcattgataatgcggttctttcttatgtggaaccctatgcatcctcttcctgtgaaatggtagcggaggtgctgcagtacattgcagatggaatcaagatcaaatcaccggaagcagatgccctttatgcagggatcgtcattgataccaataatttcactaaccagacaggtgtcaggacctttgaagcggccgctttcttaagaagaaacggtgcggacgtagtccgtgtgcggaagctgttccgggataacttagatgactataaggcaaaagcggaagccgtgcgtgatgcggagattttcgagggctgctttgccatcagcgtatgttcctcggaaggaatcgatagtcctacggtcgtaggtgctcaggcagccaatgagctgctggacatagccggaatcaaggcctccatcgtaatgacagattataatcatgcggtgtatgtaagcgcccgttccattgatgaagtcaatgtacaggtcatgatggaaaagctgggcggaggaggtcaccgcagcattgcaggtgcacagcttgcaggtgtcagcattgaagaagccaaaacccgcgtaaaagcggttattaaagagatgttagagaagggagacatatcataatggaagttgtattattagaagacgtaaaggcattgggcaagaagggacagatcgttaaggtcaacgatggatatgcgaggaatttcattctcccgaaaaagctgggtattgaagcaacaactaagaatttaaatgacttaaagcttcagaaggccaatgaggccagaattgcggcggagcatttggaagctgcaaaggaacttggaaccaagatttccgaagcgtccatcaccttaaccatgcgtgcgggagaaggtggaagagcctttggttctgtatcgggaaaagaaatctctgctgccattaagaaccagctgggatatgatattgataagaagaaactgattcttcctgaaccccttaagacctttggttcccatgaggttccagtcaagcttcataaggatgttactgcaaaattaattgttaaggtagtagaaagctaggaggcatgaacatggatgatgccctgatcaaacgggtgcttcctcacagcattgaggcagagcaatccgtcatcggttccatgctgatggaccgggatgcgatcatcacggcttccgagatcgttacagcaggagatttttaccagcaccagtatggcatcatgtttgaggccatgctggagctttttaatgagaatttaccagtggatctggtgacgcttcaaaaccgtttaaaggagaaggatgtccctcccgaggtttcaagcctggactttgtaagggatatcatcaccacggttccaacatccgccaatataaagtcttatgcaaatattgtgcagaacaaagccgtcctgcggcggcttattaaggcaaacgaagacattgcaaacacctgttacgcaggaaaggaatccctggagaccattcttgccaccacggaaaaaactatatttgacctgcttcagaaccgcagctccggagatttcgtacccatccgccaggttgccatgaacgttctggaaaagatcgaagaggcctctaaaaatcagggaaccgtgaccggaatccccacaggctttattgatctggattacaagacttccggtctgcagccttccgatttcatcctcatcgcagcccgcccttccatgggtaagacggctttcgtactgaacctggtagaccatattgcggtaaaaaaaggcctgcccagcatggtattcagccttgagatgtcaaaggaacagctggtaaaccgtatgcttgccatggaatccaacgtagattcccagaagctcagaaccggaaccttatccgattccgactgggatgccgtagtggaaggaatcggagtcatcggaaattccaagctgatcatcgacgatactcctggaatttctattggagaactgcgttccaaatgccgaaagatgaagctggaacatggtcttagcgtagtcatcatcgactaccttcagctgatgagcggaagcggaaaaggcggcgataaccgtcagcaggagatctcagaaatttccagatcccttaaaggcctggcaagagagctaagcgctcccgtaatcgccctatcacagttaagccgtgcctgtgaaacaaggcaagaccaccggcctatgctttccgaccttcgagagtccggggcgattgagcaggatgccgatgtggttatgtttttgtatcgtgatgattattataataaggataccgatatgccgaatattgcggaagtaataattgctaaacagagaaatggtcctatcggaacagtaaacctggtctggaggccagagtatacaaagttcgcaaacatggccaagcaatgagcaggatagaaacagagggaccccttgccccggaaaaacaaacttgtttgcttttccggggcaaggggtccctctgtttctatggggcgaatgccccccatctgggagaatggattgctcctcaaatccattctcccagatggcccctgcgggctcgaagtatatccaaagcataccccgccggattccagcaagcgcctatattctcaatgctcccctcagcattctcaaagcctcccgcctatattctcaaacaccccccaccccctcaaatctcccccactaaactcccttctccatcattccccatccctcccccattcaaatattttctcaattcccttataaaattttccaattcccattcataatcccttcgaatcccgcatatgatataaatagtaaggttatgaaaactaaacgaaccaaaggagaggatatagctatggctgagatacattacttaatatcggatgcatcgaagaaggtcgatgtggagtctcatgtccttagatactgggaggacgagctggagttaaaaattcccagaaatgagatggggcaccggtattacactgaagcacacatccgtttattcaagcagatcaaagacttaaaggagaagggatatcagttaaaagccattaagacagcgcttgataaggttattgaggacggcagggatcctgtcataccagatgaattattagagggacaggttgctcaggaattaaaagacagtgcaatatctggtacggaggacgggacaggcctggaggtacagacatcggcgccgatttccgttgcccatgaaaaaatggagcagtttcaggagatcatgaaccatatcattggacgggccttagaagtaaataatgagcagttaagccaggatgtaagcagcctggttaatgacaaggtcattaaagagatggaatatttaatgaatttaaaagaagaaaaagaggaagagcggttcaagcagttggacgagcttatgcgttcgtatcagaaagataacaaagggcgtgcggaagctgccgcttccaagatcccattttttaaccgtaaaaagaagttcggacgaaatggaaaaaagttataaaaccacactactttcagataattagagctgccaaaagggctcaggcaaaggaatccgcagctgccgctgaaagtggaaactgcggattttttacgtatataaagtcattctttgcaggcttctacaaacgtctgaaacagtcggaacgcctcttcattcttttcccatagatattccggatgccattgaactccgataaaaaagggatagccaggcatttcaagggcttcgatcaaatgatcggtcgagtaagcagaagcaataagccctggagcaatgtctttgactgcctgatggtgcatgctgttgacctttaaagaggagcaccccgatatcctggcaagaaggctgcccttggttagggaaaccgtatggcatggcatatcataatgaaacggctgggagtgggcgagaggaaaatcccgtttcacctgggagggaatatcctgccagatatttcccccaagcgcgatatttaagacctggataccccggcagattccaagcacaggctttctaagttccatgatcatgggaagcagggaaatttccatctggtccctggccggggatacattgccgcagtgctcctgtgtctcttctccaaaaaggaaggggtggacatcgggaccgcctgtgaacagaaatccgtccagttcctgggaaagctgctttaaatcctcttctgaggcatctaagggcattatgaccgggattgctcccgcagcttttaatgcccgcatataagtaggacgcgccttcacatcaccgctctcaatatcatgggcaggggtcaggccgatcagtggttttctcatactagaaatgtcctttccttattaaaggctgaaagaacaacatctttcaaccttagatttgcgaatcagctggatgtgcagccatatccgcttgattcattagtatgcaaatatgaagaatgtgatgatataacaaaatgcctcttcccgaaggaagaggcatttatgtatccataattatgcttcagaaatagctcctgttggacagacaccttcacaagcaccacaatcgatacaactatctgcatcaataacaaactgagaatcaccctggctgatagcgcttactgggcactcagcttcacagcttccgcagctaacgcaagcgtcactaataacacgtgccatgataaattacctccttataatctatagatttttctatattttatactattaataagaattattcaagtagtaaatggtacaattattgtttaattttgggagcaataccggtcggggatccctgtgcggacatccctgattccgcttaagatgatcttcttggcggcaacggctccttctctggacatgggaggggtatcctttaaagggtagtccagacccatgctttcgtatttcaccttacccatgtcgtgatagggcaggacatcaagagccttgacgtttttaagtccgccgatgaagcgtcccagcctgtataagtcaggggcctggtccgtgatctgaggcactgccacgtggcggacccacaccggaatatcccggtcgcttaagtaactggcaaaatccaggatatttccattggaatgccctgtaagcgtttggtgctttgtgtcgtcaatgtgcttgatatccagcatgactagatcggttaggtccagaagccggtctatttttttcaaataatccggatcattcctgtggaacgtgacgcctgaggtatcaagacaggtatggatgtctttcttttttgcagcttcaaaaagctctgtcacaaaatccagctgcataaggggttccccgccggtggcagttatgccgccgccccggtagaaactccgggacgactcatactgcgttaacagttcttctgccgtcataggcgtgccgcctgccattttccaggtgtccggattgtggcagtactggcagcgcatgggacagccctgtaaaaagatcaccatgcgcacacccggtccgtcaacggtgccgaagctttcaatggaatgaatatatcctgtcatgcacatcgccttctttgtcttttattacatgttgctgtggaacgtacgggagattacctcatcctgctgttcctttgtcagtttgataaaattcactgcataaccggacacccgtacggtaagctgtgggtaattctccggatgcttctgggcatccaaaagggtgtcgcgggtgaacacattgacatttaagtggtgtccgccttcttctacataaccatccaataaatttacaaggttgttgatttgagattcgctgatatttgccatattatgatcctcctcttgtgcttaataagtgtcttccataaacagccggttgctttccgggtcttcattatcagtatcagtgtccatgccctcaaacagggtgggcactctgcaggcggaatttccatctgcacaatccgtggaactcatagttgtaactgattttgccattgttttatcggtgcttacggtaccgtcctccgatacgcggatgttcatatgaccaaccttttcggtcataaactgatccagcatggagacgatttcgtcaatctgtttttcctttgggtctgccataacagccactccttattttcatatactgacgaatcaaggggatatgcggacatatccagttgatttacaaacttaagtttaaaagatgatttttatatttgatcatcgttaagagccagttctaaatctacctctaaatcgcctgtgaaaatctgatcttccttgccaagggcacctggtacgatggagaaggtattggagatgccatcctgggcatctttaaacggaagctttgccactgacgccagagaggcgacagcgccgtgggtatcccgatggtgcatgggatttgcacccggtgcaaaggcttctcctttcttacgtccgtcaggagttgctcctgtattcttaccgtataccacattggatgtgattgtcaggatcgaggtagttggaatgccgccgcggtaggtgtggtttccttttacatagttcatgaaggtgtggaccagttcgtttgcaatctggtctacccggtcatcgttattgccgtatttcgggaagtctccctctacaatgtagtcagtaacgattccgttttcatcccgcagggtctttaccttggcatatttgattgcggataaagagtcggccacaacggaaagcccggcgattccggtggcaaaccagcgggtcacctttttatcgtgaagagccatctgaatgcgctcgtagctgtatttgtcatgcatatagtggatgatgttcaaggtgtttacataaactcttgcaagccatctcatcatatccttataggcttccattacctcatcgtaatccagatattcggaagtgattgggcggtatttggggcctacctgctttttggagacttcatcaatgcctccgttaatggcgtacagcaggcactttgcaagattggcccgtgcgccgaagaactgcatttctttaccgaccctcatggaagatacgcagcatgcaatggcataatcatctccgtgggtcactctcattaagtcgtcattttcatactgaatggatgaggactcaatggaggtcttggcgcagaagcgcttaaagttttcaggaagctttgtggaccagagaacggttaagttgggttccggagcggttcctaagttcttaagggtgtgaaggtaacggaaggaagtcttggtcaccagatggcgtccgtcgatgcccactcctccgatggattctgttacccaggtaggatcaccggagaacagctcgttgtattccggtgtgcgggcgaatttgactaagcggagcttcatgatgaagtggtccacaaactcctggatatcctcctcggtaaaggttccttcctctaaatctctttgagcgtaagcatctataaaggtagaggtgcggcctaaggacatggcagctccattctgttccttgacagcggcaaggtaggcgaaatacatccactggatggcttcttttacattggcggctggcctggaaatatcaaatccatagatgcttcccagttttttcagttccttaagggcgcggatctgttcggaaagctcttccctttcccggattacatcagagtacataatggtacgggtggttaccttctgttcttccttatcctcgatcagccggtcaattccgtaaagggccactcggcggtaatcaccgatgatgcgtccccggccgtaagcgtcgggaagacctgtgatgatgtggttggaacggcagtccctcatttcctgggtgtaagcgtcaaaaactccggcattgtgtgtctttctgtgaatcataaaaaattccttgacttcaggatcaatggtgtagccattatccgcacaggatttttctgccatacggatgccgccgtaaggctgtaaggaacgcttaaatggcttatcggtctgaaagcctacgatggtttctttctctttatttaaatatcccgggccgtgggaggtgatggtagagatgatctttgtatccatatccagcacgccgccggcgtcccgttcctgtctggataaatccatgacctgtgcccaaagttcatttgttgctgcagtcggcccggcaaggaaggtatcatcgccgtcatagggagtgtaattcttctgtataaagtccctgacgttgatctcccgttcccaaacaccgcctgtgaaagctctccattctgttcgcatagtattgtacctccgtaagatctattgtataagtggtaattattaatgagtgccatcaaagattataattcatacaatctttgtatgaatacattatatatgaatactgtatacaatgtcaagagcccttaatgagaaaaattcattagaaaaggtgacgaatgaaaaaagaggaatttagtccttgctaatcacagggaaaagtattatattagaaagacagtaaatacaattttttaaggaggaatacaagatgcagatccaaaaggatatgttaataggcgcattgcttgagatggacgagaacattgcacctatgttaatgcgcgcaggtatgcattgcctcggctgtccggcatctcagggcgaatccctggaagaagcctgccaggttcatggaatagactgtgatgttctggtttcacagattaatgaagtgttggaagaacgatagaatatgttacaggaggcagtccttcaggactagcctcctgttttttatgcagataacgagccgggcgattgattatggctgccgtttttcatctctgtaatgtttagggctgacgccgaattcctgcttgaatattttggaaaaggtcaaagggttatgatatccgatgcctgtggcgatttcctgaatggacaaggttgtggtagccagttgattggcggcgatgcccaggcggaatctcattaaatattcctgaggtgaaacgtgaagctgctttttaaagatcgaggttaaataagagcggttgatcccgatgtagtctgcaatatcctgaaccttgatcctgtcgtagttcagcttgatatactgaagggcataatccacgtaagtatcaatggaataatcgtactggttcttcttaatggttcttatggtgttctgcatttcgatcagagtggacaggatctcatataagtatcctacccgcttgatctcattggcaaaggtcagctcgctggtatccaggatcttgtgtatcatgggaagatagagctggttagggatctgggaatggatggaaggaagctgggcagataagcctgcgtagcttaaataggcatccgccatttccccgtcaaaggtgatccacatgtattcccaggggtttttatggtctgcgttataaagaacgggatggcccttgggaatgagaaaaatgtcatcggtctttaactcataccgttttccgtcaatttccagggtacctgcgccgcccagaacaaagtgaaggtgattttcatttggaatcttgtgatcgtaggtgtattccggaggacactgctggattccgcagtggaccaggtacagatcattggtctgccgcttgatgtttcgtaagcagcggaagccggctacgtttttataagtggtttgtttttcgctcaaaaatataccccctcaaaatggtgaaagaccctgtcagacgatccgctttttttaggatgtttgatagggtcaagtatacaggcagcaaacgtaatttgcaaatgaaagttcctggagatatcttttaacggtacatgttcatgtagccgccgtgggctgcaatgagctcatctaccatggagcggatatcctttatgtttagctcggcagcagtgtgtggatccagcatggctgcctggtaaatggtttttatgtctctgttgtgagctgcttcaattgtgagaagctggggattgatgtttgtcatgttcatggctgcaagctgagtggggatgcgtcccacgtggcagggggtgatgccgcttccgtccacaaggcatggcacttccacacaggcgtcagacggaagattgtcgatcagcccgtggtttaaaacgcttgcgccgatcttatagggcttgttggtcagaattgcttccataatataggaggcgtattcatgggaacgggtatgggtgatctcgccgttatttaagatggaattcttttctgcctcccattcgttgatctgcttgatgcagcgtctgggatactcgtccagggggatctggaattcttcgatcatatccggatatctggattttataaacaatggattatattcggcattgtgttcgctggattccgtacaataatagcctaaatggttaatgtactcatagcggaccatatccttatgcttttctgtcttgtttttctcaatggctttctgtctgatgatggggtagaggtcgtttccatccctgtcattaagctttaaaagccaggccatatggttgatcccagcgatcagctctgttcttccctccagcttatcctccatattaagtccctttaataaggtttctgagcatacctggacgctgtggcataagccgatggttttaatggatgtatagcgctgcatgtaaccggtcagaattgccattgggttggtgtaatttaaaaaatatgcatcagggcaaacctcttccatatctctggcgaaatcttccataacgggaatggtccttaagcccctcataatgccgccgattccaagggtgtctgcaatggtttgctttaagccgtatttcttaggaatttcaaaatccgttatggtgcagggatcgtatcctcccacctgaatggcattcaccacaaaggtggcacctgccagggcttccttccggttttccactcccagataggtctttatgccggcctgtccctgattcacatttttgttgattgcattcaggatcagttccgaatccgcaagccggaccgggtcaatgtcgtaaagagcgatcacagcatctttaagcactggggtgcacatgcagtcacccaggacatttctggcaaatatcgtgcttccagcccccataaaagttatttttaccatgttccttcctccttgttttccttgtctgtcttatgaggatattgtataattacagcaggaaaaaagataggatgtttgtttcatgaaattgtcgttttgttgtatggagggattaatatgaatcagtcggcaagggggttgaccatttattactgcggccgtgagcattgtgcatccggtcactttttcggtcctgcaatacgaaaacattacctgatgcatgtggtgctgggaggaaaaggcatttacaggacaggaggaaaggaatacgctttaaaggaaggggacgcatttttaatcaagccccaggaggtgacttattatcaggctgataaggacgagccatgggaatacgcctgggcggcctttgcaggagcagaagccgagcggcttttaaccgattactgccaggaggaaaacgggtatgtttatcattttggtcttgaggatgaatggcgtacctatatggaagggctggtggccgcttttcaaagcggaggacataatatggatgaaatggctgggtatctttatctgctgttttcccggtttcctaaggaagaaaaggaagggggagagtatgagcagagctatttgtcccgggccgaagcgtatatccgccataattacagctatcctattcagatcggggatatagcaaactatgtagggattgaccgtacctatttgtacaggctttttataaaatacaaagggatctccccaaagcattatttaacagcctaccggatcatggaggccaagcgtttgctggaggataccggccttagcgtaacggaaaccggtttgtcctgtgggtttcacgatgcttcggttttttgcaagagttttcttcagacagagggaaagtcaccccttcagtatagaaagggaatgagggaagaagttcggtaaatataacaaaacaccatgtacctgtcacattagtctatgtaatatagatgaaaaatggtttataatcaacattggtaaaagaaaaatacacaaaaaaaggttgtatactcagttttaactatataaactgactaatcaaagggaggtagcaaaatgaaacggaaatggtggtttacggcggcaatggcagcggttatggcagcagcactggttggctgcggaagcaacgccggaaaggagactgctcctgcaagctcaggggaaacaaagcaggaagcagaaagctccagtgagtcaggaaatgccggggcacagggaactctgacagttgccatctgggataaaaaccaggagccgggactgacagaaatcatgaaggactttacaaatgaaacaggaatcaagacacagatccaggtaactccttgggagcagtactggaccatgctggaggcaggagccaccggaggatctcttccagatgttttctggatgcattccaatgagatcgcaaggtactctgaatatgaaatgcttttgaacttaacggaccggatcaaggatagcaagaccctggaaatggataaattccccaaggatatcgtgcagatctataattgggaaggtacaaagcagtatgcggtgccaaaggatatcgacaccattgctctctggtacaataagaccatgtttgacgaagcaggaatcccctatcctgacaaggactggacctggaacgattttgcagaggcagcaaaaaaactgaccaagtccgacggaagccagtatggatttgccttaaggccaaccaatgaccaggcaggctggaacaatatcgtttacgatatgggcggttatgtgatcagcgaggataagaaatcatccggttttgaccagccgggaaccatcaaggcgttaacgttcataacagacttaatgaaagagggatatgctcctccatacgaagtgatggcggagaatacggaggaagctttgtttgaagcaggcaaggtagccatgatcaccgcaggttcctggatgcttccggagctttgcaacaatgattatgtaaaggcaaactgtgatatcgcaatgcttccgaaagatgctgagacgggaaagagaatctccatttacaatggacttggctgggcagcttccgccaataccggcatgcctgaggaagcatggaagcttattgaatatatgggatcaaaggcagcacagcagaagcagtctgaccttggaatcgttatctctgcctatgaaggaacaacggataactggatcaaggcatatcagggctttaaccttcaggcatacttggatatgatgggtgatctggtgatcaggccatactccaaatcaacggttgcatggaacaatatgagccatgaaaaattgattgatgcatggaccggtgccaagagtgtggaagatgtctgcaaggacattgctcaggaaatgaatgccatgctggcacaagaataggaagggctggggaggcaggctgtaaagcgcctcccctttttaatcgaatcaagcagcgaagcggatcgggaatatccgcttttcaaagaaatacggagggtctgcatgaataaaaaatcaaaggtatcaaggcgggcgagaagtgaatttttatggggatggatgtttttgctgcccaccatggcgggtcttatcattttaaacatcatcccaattttccagaccatttaccagagctttttcaaaacaggagcttttggaaaaggcaatgtatttatcgggcttgacaattaccgtaagcttttcagtgacgggaccgtatggcaggctttgtggaacacgtgtaaatatgctgtggtggaagtgcccttttccattgccattgcccttgtgatagccgtctttttaaacggaaagatccggggacgatccatctggaggaccatttatttcctgcccatggtggcggctcccgctgcggtggccatggtctggcggtggctttataactcggagttcggactccttaaccatttgctgcgggcgattggccttcccggagtgaactggatctccaatcctaatattgcattcatctctgtggctgtggtcgggatctggtctgtgatcggttacaatatggttcttttctttgcaggccttcaggaaatacccagggattattatgaggcggcgcagattgacggggcggatggtatcagccagttctttaccattacactgcctttaatatccccaaccatgtttttcgtgactgtgaccagggttattggggcaatgcaggtgtttgacagcatttatatgatgatgggcagaaacaatccggctctgggaaggacccagtccctggtgtatcttttctataaatattcctttattgagggaaacaagggctacggctcttccattgtcatgctgctgctttttgtgatccttctgatcacggtgattcagatgatctgccagaaaaaatgggtgaattatagctaggagaggagaactatgaataagaatacaaaaatcagatcaggtatcgtttacttaatccttatcatagggtccgccatcatgctggtaccctttttatggatgtttttaacagcctttaaaagcacatctgaggccacccagatgaatcccttcatcatttttccgacagtatggaggaaagaagcattcttatctgtggtgagtaaaatgaacttttttaggctgtactggaacacgcttctgctcatcgtggaacgagtcatttgtgcggtgctcaccgctactatggctggatatgctttcggacgccttaattttaaaggaaagaatctggctttttccctggttcttttccagatgatggtgccatcccagatctttatcatcccccagtacttaatggtgagtaagcttggaatgttaaacacttcatttggactgcttttcccaggacttgtgacggcctttggtacattcctcctaaggcaggcttatatggggcttccggcttctttggaggaagcggccagactggatggctgcaatatcggccagacctttctctatgtgatggctccccttacgaaatcttccatggtggctctgggcatttttaccgctctgtttgcatttaaagagctgatgtggcctctggtcgttaacacagagcagaacacaatgcccttatccgctgcccttgcaaagctgcagggacagtttgaaacaaactatccggagcttatggcagcatccttgctggcctgtattccaatgattatcatatatcttatattccagaagcagtttatagaaggaattgctacatccggaggaaaattataaaaggagtcgacttatgcctatcatttatcatgaacaagcaaatcagtttcacctgtataatcagtccgtgagctatatcatccagatcatggccaatggacagctgggaaatctgtattatgggaaacgcattacggacagggagtcctatgcatatcttcttgagacaggggagcgctctcacgcagccatcacctgtccggaaccggtgagtctttgtttacagtatacaaagcaggaatatccggcttatggaacaggggattaccggtacggtgcctgcattgtcagacaggagaatggcagcaggatcagcagcttcacctatgtgtcccataaaatctttgggggaaaacggtccatagaacctcttcctgccacctatgtggaagaggagaaagaggccgttaccctggaggtcacccttcgtgatgaggtgttgggtacggacctgatcctttcctataccatttatgaagaactgccggtcatcacaaggcatgcccgttttgatcaccggggcaaggaggagatcgtccttctgaccgcaatgagcggagcggtggacttaccggattgtgattacgagatgatccagctttcaggggcatggtccagagagcggtatttgaagaggcgtgtcctggaacagggaatccagtccatttacagcatgagaggaatcagcagtgcagagcataatccatttctggctctggcgagaaaagagactacggaaaaaagcggccaggtatacggcttcagccttgtgtacagcggaagcttcttaggacaggtggaggtctgcacccatgataccacccgggtgctctttgggatccatccggatacctttgaatggcctttgaaaacaggggaatcttttcagactccggagcttgtgatggtgtattcggaccagggactttcccatatgagccagatgttccaccgtttatacaggacccggcttgcaaggggatattggagggacagggaaagacctgtgcttttaaataactgggaagccacctacatggatttcaacgaagaaaagatccttgacattgcacagaaggcgaaggaaaccggagtggagctgtttgtcctggatgacgggtggtttggggagcgcaacgacgactacagagctttgggagactggtatgtgaacaaggaaaagcttccggaggggatttccgggctgtcggagaagatcgaggctctgggtttaaaattcggtttgtggatcgaaccggaaatggtcaataagaacagccgtttttacgaggcccatccggactggatcctgtccgctcccggacgctatgaaacccccagcagaaaccagcatgtccttgatttttcaaggaaaaaagtggttgatgcggtttatggcatgttaaaagagatcattggtaatgccaggatttcctatattaaatgggatatgaaccggtatttaacggaatgttattccaaagggactctccctgagagccagggaatggtgatgcataaatttatcctgggagtctatgacttatataccaggtttaccagggattttccgaagatcttatttgaatcctgtgccagcggaggggccaggtttgatcctggaatgctttactttgctccccaggcatggtgcagcgacaatactgatgcaatggaccggctgaagatccagtacgggaccagtatggtctatcccatatccagcatcggagcccatgtttccgcagttccaaaccatcaggtacacaggatcacgcctttggaatcaaggggaaatgcggcaattttcggagcttttggatatgaactggatttaaataaactgacctccgaggaaatagaggtggttaaacagcagatcgtttgctacaaaaagtaccggaagcttttgcaccagggtacattttaccggcttaagagtccttttgaagggaatgacacagcctggatcacggtgtcagaggacatggaacaggcagttggcgcctattttcaggtcctgaatccagtcaatgccggctggctcagactgaggcttcagggcctttgccaggaaatgctgtatcaggtttccctgcctgggatgaccggcgaatattttggaagtgagcttatgtacgccggtattcccattgacagaggacgcctgttaaaggagacaggagattttgcctctttcctcttttttgttaagaaaaaacaggaataagaaaaatagtccggtcaggcgttgaccggactattttaatgtaataaattacattatctttaagaacctttctttattttattgaaaaaaattttacagcatgttataatgccttaaaaataatgcattattcctcaaaaactgaacataggggatgattacaatgaaggattataatgtacacttaacactgattgacagaattatactggattcctataagatcatgctggaagggctggcggattatctgggggaggctatgagatggtacttcatagtctggaggatacggaacattccgtcataaagatcatcaatggacaccatacaggacgcgcggaaggaatgccgattacggacctggctcttcagatgctggaagaaatcgaaaaagatggcgaaaagagctatatttcctatttcaccaagaacaaaaaagaagaaccattaaaatcctctaccattgtagtgcgcgggaggaggggaggattatcggacttttatgtatcaatttttatttgaatacaggtttatccgatatcctgtccagctattttccccaaatatcctcacattccctggttaaatccgaaacttttgcaaataatctggatgaattaattctcagcaaagtcaaagaggttcggaaaaccgtaatggaagatgatggaatacttccgtctcttaaaaacaaggagatcattaactctttgcaccaacagggggtttttaccctgaaagatgcggttgtaaaggtggctgattacctggggatttctaaaaacaccgtatatatgcacattcggaatgcgggggtaattacagaaaagagaaatgaataaacattaatacagcaaaacctgatgcaaagaaaaatcctgcagtcatttgtgcaatattacaaagaaactgcgggatttttgtttgattattagaaaaatataatgacattgcaatctttataaatttatgataaaataaattacatcaaaaaaataaaataaataaaatttattttactcatcgaaaggaaggtattgatatggaggaaagtaaaaagagtaagaagggactggggctggtaccaaggctgattattgcaattatcattggtattttgatcggaatgtattgtccaagctttgtaacttcaatattgatcactatatcagatttgtttaagcagtttttaatgtttatcattccgcttatggtagtagcttttgttacaatgggaattgcagacttatctcagggagcaggaaagctgctggcgtttaccgcggcaatttcttatgcttccacgctgctggctggaagtgcagcttatgcggttgccagtacgtttttcccctcttttgtgaatgaagaggtagtagcgaaagttgcatctgcaagtgataaggccatcagcggatatttctctctggccatcactccgctgcttgaaacaacagccgctgttgtacttgcctttgtactgggcgtatgcatcagcaccatgcggggcaaagagatcggggataccttgtataatgtgatcaaagactttgctgagattattacaaaagtactgggccgtgtgattattccgcttcttcctttatatatctgcggaacttttgccaagatgacatatcagggaaccacctttgcaattatgtccgtgctttggaaggtattcctgatcgtaatacttcttcatttgatctatttgcttgtagcctttacctttgcaggcataatgacaaaacgaaatcctgtcaccatgctgaaaaaccagctgccaggttacttaaccgcaatcggtacacagtcttctgcggcaaccattccggttaacatcaagtgtgcggaaagtaatggcatttcagaagaaatccgtaatttcgtaattccgctgtgcgctaacattcatatggcaggttccatgatcaccattacctgctgtgtgaccgcgaccctgcttatttacggcatgcctcatggcttccttaccatatttccatttatctgtgtgctgggagtagccctggttgcatctccgggagctccgggaggttccatctttacggcgacaccgttcttccccattgttggaataccggcagtgggtgatattgccagccttcttcaggcaatgtatattgcacaggacagcttcggaactgcttgtaacgtatcaggagataatgcaatcagtgcattggttgatatgtattaccacaaatatattaaaaaagataacttacaataaggtgactgggaaaggagaagaccgtttatgccgtctatcagtatttttgatgtaatcggccccaatatggtagggccatccagttcccataccgcgggtgctgtggcgattgctcttctggttaaaaagatgttcaacgggccgatcaaagaggtggaatttgttttgtatggttcttttgcaaagacctacaaaggccatgggaccgaccgtgcgcttcttggaggcatcctgggatttgagacttatgacttaaggattaaaaattcctttcagctggcggatgaatgtggactgaagtattccttccgtgtggatgaaaaagaaacagaggtgcatccaaatacagtagagattcatgtaactggagaagaggccggaaccatgtcggtccgcggagtctcgttaggaggaggtaaggtaaaaattgtcaggatcaacggaattgatgtagactttaccggagaatattccacactggtcatacggcatttggactatccgggcatggtggcctatattgcaaccagtttaagtgagcgcaatgtaaatattgctttcatgcgattgttccgggaacggaaaggggcaaccgcttactctgtggtagaatctgatgaggagattccccaggaattgttggaaaagctgcgggaacatccgaaagtagaagatgttatgcttattcaggtttaggaggcttttatggattttatatcaggaaatgaattgctgaaattatgtgaggaaaatcaatgccggatctcagaagtgatgaaggaacgtgaagccagtgagttcggcgccggttctgaagagaccatcagccggatgaaggaagcttaccggattatgaaagaatcctgccataagcccttagatgaacctgtgatttccattggcggactgatcgggggagaatctgcaaaggtacgggacagaaggagatcaggaaaatccatatgcgggagcatgctgtccaaggcgattacctattcacttgctgtcttggaggtgaatgcttctatgggacttattgtggcggcgcctacagccggaagctccggagtgctgcccgggctgctccttgccctggaagaagaattttccctgggcagtgatcagatcatagatggcctttttacggcaagtgcggttggttatctgttcatgaggaatgcgaccgtggccggagcacaggccggctgtcaggccgaagtcggtgcggcttccgcaatggcagcggcagcggcgacggaaattatgggcggtacgccgcagcagtgcatggatgcagcttcctctgccttagtaaatcttttaggtctggtctgcgacccggtagccggcctggtggaatatccctgccagaaccgcaatgttctgggtgctgccaatgcactggtatgtgcagaaatggcattgtcaggagtcaaacagttcataccctttgaccagatgctggacaccatgatggcggtggggcgctccattccatttgaattaagggaaacttcacttggcggctgtgcggttacagaggctgcctgcgggaaggcctgtgagatttttaaatcatagtaaatttattatgaacagcggtaccggtaatgcaaaaccggtaccgctttttgtttttctggatgaaaaaaatagttgcgggtgcaaccattttatgatatgctgattatcaccctaaaaagtgtaattcgcccttatggcttggaggtggaacgcatgaacgagcacagggaaatcgggaaatatatctcgattctccaaagactgaataatatgtactttgcaaatcaattatccttttatcagataggctgtggacaacagttttttttattgcagatttataaaaatccgggcatgagcctccatgaactggcttcctatggccaatatgataaagcgactgccacccgcgcggtgaagaagctggaagaagaggggtatgtcctgacggaaatggcaaaagaggacaagcgcatccgaaggatttatgttacggacaaggcggcggctgtagtggaaaaaactctggagagtgtaaatgaatgggcggatattgtattaaaggggtttactaaggaagaacgtgaagcagcggagcaaatgctcatccgcatggcctgcaatgcccgcgatcacattgtggaacagaaaggaaaggaatagagattttatggaacaagacaggataagacagggggaaaatcccctgggatataagccaatagggcatttgctgctgcagtttgcacttccagcaattgtttccatgctggtaaattcaatttacaacattgtggaccagattttcatcggacagggcatcggatatctgggaaatgcggccaccaccattgcatttcccattgtcacgattattttggccatatctaccctgctgggagcggggggaagcgcctatgcggccattaagctgggggaaaagaatgaggaggcggcggacaagactcttggaaccgttttcctggtgaccctggcagccagtgtcctggtcatggctgtggcctttccccttatgacacctatgttaaaggtttttggggcgaccgagaacactatggaatatgcgaggcagtacacctccgtcatactgttaggaactccgtttaacatgctttctgtggtgctgagcaatatggcaaggaccgatgggaatcctgctttgtccatgtacgccatattagtaggcgctgttttgaataccattttggatcctatttatatctttgtattccattggggtgtgaccggtgcggccatagctaccatcacctctcagattatatcagcagttgtcctggtgctgtactttatgtacaggggaaaacatatgcgcctcaataaaaaaggcatgcgcattgataagggtatttgccggctggctctgccccttggggtttccagcggtatcacccagatcgcgtctaccattttacaggttgtcatgaacaattctctggtgtattatggaaaccggacagccattggcggcgatgtggctttaagcgctatgggcgttgtgaataagatcggaatgatactcatttccatctgtatcgggatcggtatcggatcacagcccatacttggttttaacaagggagcgaatcagccggatcgtgtgagaaggacctttcttctggctgccagtgcggcaacagcggtttcccttataggctggcttgcctgtcagctgttccccggacagattttaagcctgtttggaactaaggatgtagagttcacccagtttgcgatccgctgtctgaagatatatatgctgggaattttttcggcgggcttccaggttgcgaccaccagctattttcagtcaacgggacagcctttaaaggcctctgttttatccatgctgcgccagcttttgctgctgattccgctgattctaatccttcccttatcctttggactggaagggatcttatatgcaggacctgtggcggatatcacatcaatggtcattgtcagtcagtttgtggtgtatgagctgaaaaaattaaacagattatgtaaggcttcgtaatgtggaggttacagttcgtctatggagaaaccatggctaaactgtaacatgtgaaatacagggaaaggagagataaaaaccatgagcatgaaagcggaaatggcaaggatttctgcaggacttaaaaaagcggacaagaaaatggcgcttaagctggaacagccggtcagaggaaggccggtgctgactcaggagctgtttacaaaaagggtgagggtcagggcctggagcgtggacggctttcctgcagtcaccataaacggaagctatgcaaaggctgcccatgtcctcatgctcccgggaggggcttataccctggaaccgtcggagcgttacagggaaatggcggagcattttgccatagaaaatcaggtaaaggtgaccataccccagtgccctctggccccggagtttacggcattggatgtccaccagtatctggtccgtgtatacagccgtcttgtggcggagtatccggaggatgagtttttcctgtttggagatttttccggcggcggcctggctctttcatttttacaggaactgcgggacatagggaatctgcccatgcctgtgaaaaccgccgtcatttctccatggcttgatatcgctcttaacaacccgaaaataaagatcgtgaaaaaaacagatccaatccttccggtggaagctttaagagaagccggtgcccgttaccgtggtcccctggaaccggatcatccctttgtgtctcctctttatgggagttgggacaatctggggcagattctggtattttcggggacagaggagattctcactccggattgtgagcttttggcggaaaaggcggggaaactgcagggaacagaaatcatttacaaaaaaggggcaaaaatgatccatgactggattttgatcccgtgcaaggaaactgatgccactttggaattgatttttgcattttttctggaagaagcttctgtattttaaaaatgaggctcggccctttttgggggccgaacctcattttttgatttgtgatgaagtactatgaacaaaggaacggattaaagttttgccagagactgaagggcgtggccctcaatcagcacctcgtaatgttccttgtagtacgcttcggaggcgtaatcctgacgaatcttggaaccatattctgcaagcaggttgcagatacggctgaaatccagagatttgtctggagtatttctgatcaccagataatactgtctggtatcaggctttttgtacaatgtattctcgccatcgtaaacctgtccgatggtccgtgcagcatcagatatctgatccaggctttgaaaacaatagattcttatagaggaagcacttgattgctcttttggctgttctgtttccggttcttcctttttgtcaatacccaacaggtttaacagtccgtcggcgccttccagcagttcgcttgccaagtctcctggcatggaatccaggtcttcgtcagctgctggtgaaaattttgcaaaccttgtatctaattcttccgggtcttcgatttttgtgatcaccagcatcacactttcgttggacaacggaattgcttctaccatgagaggaatgtcttctgcttcgaatcccacttcgttagaggctttttgaatcatctcgcggaacaggttacgggctttttcactgccataagcaagctcgcctaaatttaagtttcggacgcttaaatcaaagcttgtaagcgtacaacgaatttgattttcattaatacgttctatcttcataggatcacttcctgttctttttaaaatggtaatgaatatttacatacttcctcaacataactatactatataatatagcgaaaaagcaattactatgtgaaaaaatttatataattttaaggtttgtatgctaaaaaccgggtatcctatttgattattggaatttttcggttttattttttgatatgatgctgatttaatatgattttttgtaatttttccggaatctccgcgtggcggttttgaagaaaatgtctgaaaatattattggccaaattggctgtactgttaatttctgccgctgcgggggactgagaaaattttttattaataagagttaaaataaattacgtcagtatagtataataaggacaaatctcaaaatccgcataaacagaggatttgaggtttgtccttatgttttttctgattttttccgggtttttactaaaaccaaaccagtctctctttatatattagccatataggaggcggctcattgctgtttgcggttaaatggtataggtcttgggaccgtctgaatagctgaaagtttctacttcttctacatctatgtagaaaatctcaaaaacgggattgtcgggtgttttgtacagaccttttatgcctggattctcatccagcgcacgggcctttaaggagatatcgtcgacaaagaccgcattaccgttcacagacacaaccggtgcaaagtcggcagggtaggtacagaaggaaacataggggttggccttgatctggttgtagaccggtttttggttactggtgcagaaatataccttgttgccgtcagtaaacaagtactggaaaacacgggtttttaccttatttccatcctgggtcgccaggacaccgttggggttctcttttaaaacagctgcataatcgatcatgattgatcctccattcttttaccggcaaattgtattttgccttgctttatggtacaattatagtatgtgcatataaaattacaagtacgattttttagtatagtaggtatctatttagatagtaatggaggatttatcatgaaaaatgaaattgaaaagaaagatctgttcggtatctgcccgtattttacttctcaaaaggtattgagcgggaaatgggcgctgctgattcttcaccatctggatgagcagacacttcgttttaaagagctggagcgtgaattggctcccattacccaggctactcttacaaaacagctgcgcaatctggaagaacacggcctgatcacccgcaccgtttataataccataccgccaaaggtggaatattctttgagcgagctgggccgtgaattcagaccggtattggacagcctggaaaaatgggggatttatacatcgctcatatggaagggaaagacgtttagaaggtttgatgtaaaatagtctcaactttggtacattcattttagcattacctacctttattttggttgattgtaagtgatatttttctgtaaagtcctggaaacaggcatagaaaaaccaccctttcatatatttctaaatatagaattactgcatttgcatatgatagttgtatcgctttgaattattgtcttcactggtaccggtgcaatccggaaaacagcaaaaaatacagtgcttttctggttatcaattcctgtttttatatttttatgaaaaatagttgaaaaaacaggaggaatatattagaatataccccaagagatgatattggacagacaaaaggaggtggttttagtaagcgccgttctgtttggcaaatatcagctatacggcatcttgggaaccggccgggcagggacagtgtttttggcggttcatcttgggcttgaggagtaccgggcgatcaagcgggtacctaaaagctttctgaaatttgaagatctaaggcgtgaagcactggttcttaaagaactgcgccatcctggaattcccattatttatgacgtagaagaagacgaattttatagttatttgatcgaagagtatctggaaggagaatctttatatgaccttgtaaaaaaacagggccatctatcgcgggcactgaccatatcatatggaattcagttgaccagcatcatcagttacctgcatctcgcaggaccaaaccccatattacatttggatttacagccgaaaaacctgttattgtgccatgacaccataaaactgatcgactttggacttgctgcatccctggctgatgcaaatatgcccggagaacggtacggaaccgtgggttgtgcggcgccggagcagtattcaaagaatggagtgctggatgttagaacagatatttatgccattggtactatcattcattacctgtttacaggagaatttccaaaactgccttataaaccggctgcatcaatggataccgatctggctgcccttattaaacggtgcataaaaaaggaaaaggaagaacggttttcatcagcaaaggagctggaagaaaggctcagacagcttgaaaacatgggaacggctgcaaaggaccgtctacaatcatcatctcttacaattgctcttgcagggagcaaatcaggggccggaacgactcatataggaatcggcctgtctgtttatcttagaaatcacggatatcccaatttatttgaagaaaaaaataactctggcatgggcgccgggcttggtgactatgcgtctgcaaaacgggaccagtatggtctgatgcgctgccgtggctttgtctggaaaccttattatggtccgggagtgaagttaaaagatccgccctttagggtccgcattctggattatggaaaagatcttgagcaggcgctgggggcaggccccgacagggtgatactgatatgcgacggcagcagctggagcagaagcagcacctttttctcagtagaacaggttgtaaaagggcgtattccctatgggatcgtatacaaccatgcagccgggggatcaggataaggctgcctgaaggggcggctccctcccgatgcttgaaggccccttattatccggatccttttgccccagatgcggaagcagaagatttttacaaggtgttcctggaagaaattttagaaataaaaataaggagaaaaaaagggatcagcgggcttgcaggctggatcgcacagcggctgaccggaatgcttccgggcaaagaccgtacctttgggaaaggataaacgccgcatgaatggaatggcagaaaaggtatggaagcttttgcgctccggtaaaaagccggtcagccaggaagtcattgggattataggcaccggcagaggagtgggggtgactcattatacggttatgacggcaggatatctgggcggggtcctgggaaagaggtgtgcggttttggagtggaacagtcatggggatttccggaacatgagaaagctgtgcgctgaggaaaaggcccaggcagaattctgccggatcctggaggcggattattatgaaagagcggggattgataccctgctattgtgtaaaaagtccggttaccaggcggtgattgtggattacggaaccgtaaaggaaggcaatctggaagagtttttaagatgtgacaggcaatttgttctcggaagcttgagtgagtggcagatagaagcgtttctggagtttgagggaaagaggaaaaaagcggaaaagagctggaagactctcgtgtcatttggcagcgaggaagccagaaggaatgcagaaaagaggcttaaaatacccatctttcggattccggtttcagtagacgcatttgctgtcaccggtgaaatcataggcttttaccagcagtttttttaggcctggggagggattgtgtcacggcaatatccttgtggttctctcccgggcctatgcagtacaaatgaaatgatacgggggagatgtggatgagaacagaggatgccagggaaaggaatgagcgcacaaaagaaggtgagtatctggcagggctcaaaaaataccgggatcagggaattgccatcattattgacggagaggaactgccggaggaagattggaacaaaatatttgaagtaagggaggacaacagtttttacatggccgattatattcctgacaaaaagacaggaaagctgcaggaaataagatttgaccgggtttataaccggtaaattttagaaagtgccaaaggggacgcgcgctggatgccatcttcagccttaagctggtcatataagcgcgtcagggtaggatcaggggatttggaacgtaatgaaaatgtaaattccaaaaaagaagaattgtggtataatcttcacgtaagcaatgagcagtgggaaaaagtcaggagaagattttcgttgtgcccgcacataagaaaatcttatcatgatctttttcatagggcgaatgcccgtgagcctgtgaatcctcaggattcgcaggcttgcactacggatgcatggtacatacaggaggaaagcagatgaagaagaaagcagtgccggttcttgcggcgctaggattaattttgttagtgaccgcggggtttttcggggtccggtttctggaacggtatattccgtcaaaggaacaggcagatataaccgaactgctgggagtaaaagaagatgaagttgccctctatctcaatgaggatttgcaggaagcaaaggggctttttctgcagggacagacctacctcccaatcacgtgggtaaatgatatgctgaatgaacggttttactgggacagcaatgaaaagctcctggtgtacgccctgccggacaccattgtctatgcggatcattccactgtcggagcgtcggggaaacccctcatatgggtggatgaaaacggggtttatttgtccatcggtctggtggcaaattatacggatatccgcgtgacggcctatgacggagctcagttcaagcggatctttataaataataactgggatgcccagaaaaaagccattgtttcccaaaaggggaatgtcagggtaaagggcggagtgaaaagccctattgtgacctggatctctcctggaagccaggttacggtcctggaatccatggaaaaatgggataaggtgcggactgatgacggatttgtgggctatgtggaacgcaagcggcttggagagatgaccagcgaggttcctgcaagcacctttgaaaagccggtttacaccagtatttccatggaagaaccggtttgtcttgcctggcaccaaatgacgaatccggaaggaaatgcttcctttgacagcctgatcgccaatacgaaaggggtcaatgtcatttcccccacctggtatgagcttacggacaatgaggggaacttccggtctcttgcccaggcggattatgtaaaaaaggcccatgacaaaggactgaaggtctgggctctcatcaataatttcagccctgatgtgaatacggagatcctcatgtcaaagacctccaccagacggaaactgattgaagctcttatgtctgaggtggaacaatacggcctcgacgggatcaacctggattttgaggggatcaaggaagaagcaggggtccattatatccagttcatacgggagctttccataccttgccgcaagaaagggatcgttctttccgtggacaattacgttccggctcctggcaaccagttttataaccggaaggaacaggggatcgtggcggattacgtaattgttatgggatatgatgagcattatgcaggcggagatgccggctccgttgcttccattaattatgtggaaaacggaattaaggataccctggctcaggtgccaaaggaaaaggtgatcaatgggatcccctttatacaagggtgtggaccgagggagaagacgggaaagtcacctcctcttctatgggtgttgcccgtgcaaaggagtgggtcagtgaaaataatgtggaattgtactggcaggaggaattaggccagtattacggggaactgcagtcagaggaaggaattaaaaagctgtggctggaggaggaacgctccattaagcttaagatggatttaatcaagcagtatgacctggcaggggtggcctgctggaagctgggatttgagccctcagatttatgggatgaaatccagtttgataaaaaatagacaaatgatgtgaaagagacaggaaggtcaggttatgagaaacaggatcgtattggcagcattactggccgcggcatgcatgctggcgggttgttctttaaaggaagcggtgcaggaaagcaccaccgcagaaaccactctgcctcgggagacggaaactacaaaggcagaaccacccaccacagaagaagttccccaaacttccgaagaaccggcttcagagccgccggaggaaaccattgaaggtggctgcaagatcattgtggctacggatatgcactacttagccagggacctgactgattttcagaaaggttttcagtacagcatagaccatggcgacggcaaggtgatgcagtatatctgggaaatcaccgatgcctttgtggaagaggtgaagaaggagcggccggacctggtgatcttaagcggggatttgacctataacggggaaaaggaaagccatgaggaatttaccgaaaagcttggagaactggaagaagccgggattcccgtaatcgttataccgggaaaccatgacatcaataatccccaggcagctcagtttgtgggagatacctttttgggggcggaaaatatcactccggaagaatttgaagagatttaccaggattttggatacaatgaagcggtcagccgtgatcctgcttccttaagctatgtttaccagataaatgactataccagggcattaatgcttgatacctgccagtacgaaccaaagaatctggtgggcggaatgatacgggatgatacatatgactggattgaagagcagatggaagaagcatggaatctgggaatgaatgtgatacctgtagcccaccataatcttcttgatgaaagtgaggtatacttgcaggactgcaccattgaacacagcgaacagctcattgaccagctggaaagctgggaggtgcccttgtttttaagcggtcaccttcatgtacagcactacatgaggtcaggtagtgataccgggatttatgagattgtgaccagttccttatccacgccgccctgccagtatggagtcctatattatggagatgacggtagtttccgttatcatacaaattccctggatatggagggctgggcgaaagagactggaagcaccgataagaatcttttgaactttgatgaatttggaaagaagttcttaagtaaggtgttttataaccaggcccaggatgaatttaagagccttgatacgtttaaggacctgacaaaatatcagaaggagcagatggcaaaggtctatgcagagcttaatgccgcctgctatgcgggaaaagtggcggacatccgggataaggctatggcaaaggccggttataagatgtgggaggaagaagggtatcccagcattctggcccaatatctggaatggatcacctcggatggaacaaaggactataatgtattgagttcagaatgacaggaaagtagcagggagcagttcttttttatttcgctgaaagatataattcattaagaaagtgaattaggtagaaaatgtgaaattaaaaaagtgggaaccctttatggcactgattttgctggtgctggtatatgtgatatcaactcaggccggaaagatggcggcaggggtcaatgcaaaggccggaaaagaaaaacctgtggtggtcattgatgcgggacacggaggaaatgatccgggaaagatcggcgttgacggaaccctggaaaaagatataaatctgcagatcgcaaaacgtttaaagaagtatctggaagcttccgacgtggaagtggtcctgaccagggaagatgacaatggtctgtattccgaaagggacagcaaaaaaaagatggctgacatgaacaagcgctgtgagatcatcaatgatgtaagcccggctctcaccgtcagcatccaccagaacagctatcaccaggcggatgttttcggaggacaggtattttactataaaaagtccggaaatggaaaaaagctggcagagatcctgcaggaccggtttgattacgtgctgggggaacagaacaccagactggcaaagcccaatgataactattatctgcttttgcatgtgcggacccccattgtgattgtggaatgcggatttttgactaactggaaggaaacggctctcttaaattccccggattaccaggaccggctggcattcaccattcacatgggaattatgcagtatttgaatgaaagatgaaaaagtgccggagatgccaccgctgtaaggcggcattaagaggaatcttacatagcggcccgagcaataaatgtgcaggatctatcgtatgagaaaacaccttgaaatggttattactgaccagtcaaggtgtttttttatgtccgttttgcaggagatcctcccgtttcctgtataatttcaaagaaagaaaaggtggaggaatagatggaagaaaaaattgctggtaacgggtggaacagttatcccatggttttggtcataaacggacagacccatcaccgcctgggagctgcgcagctgtcccggactgcgatataaaacggaaggtcgagtttaaccggcaggcggtggccgccctcaatgcggtcaatgaggatctttgccgtcatctggcccatttcttccacagggatatgaaccgtggtgagcattggagtcagatactgggcagtgtcaatgtcatcaatgctgatgattgagacgtctccggggattttaaggccggcttcatgaaaggccttcatggctccgatggctgtgatatcgttgctgcagaaataggcggtggcgtcacaaccggcatttaaaaggcgctttgccccctgatagccaccctctgaggaaagggccacgttggcaacatactccttgcacagggggatcctgcgggcctttagaccgtcgcagtatccggtataacggttttcggatttggtttccccgatgtatgcgattttccggtgtcccagtccggttaaatagccggtggccgcaagggcggcctggtgtccgtcgcagatgatctgatcgtattttgcttccagattatttaagcctgtataggccaggcagttgaaatatttcttcaaaaggccgagaagctgtttatcgcagcgccccagaatcacgaccccgtccacctggttgtctgtgatcaggcggaaggtgcctggatgattgatatcaaaagaagaaaaggaatattttaacacatagtttcgtttaaaggcttcctgttcaatgctgcgggcgagggaggagaaaaataagtcggttacagtatccgttgtacgcgcgaataagcaggcaatggagcgggaggagacaagggctgcttttttctctccaagctttaagttacgggcagtgggattgggcgtgtatccggtccggcgcacgatctcccagatccggtcctgtacttccttgctggccgcgccatgagtgttattgttcacgaccctggatacggtggaaatggacacgccggcttcttccgctatttcctttaatgtcatattctacctccgtaaaaatatcttgaatgttattataaatcatgatccataaaaacagtataccataaaacccaaacgtttgggtaaaatttgcacaaatccgggggagaatatgttacgctgatatcatagaaacggaaacctttgggtttcggtacaatgcagtgaaatgattttgtaaagaggagagtggatcagaaatatgaatggcaatgttctggtagtacatggaggcggccctactgccgtgatcaattcctccctgtatggcgtgatcaaagaggcaaaggaaagcaaaaaggttgaaaaggtatacgctgccatgggaggcagcgaggggatattaaaagaggattttctggatctcatgaactttccggaggaaaagcttcagctgcttttggaaactccatcctcgtctatcggttcctccaggtacgccctggagaaggaagattatgaggccatgtctgccatatttgaaaaatatcatatcaggtatgttcttcttaatggaggcaacgggaccatggacacctgcggaaagatcaatgaagcctgtagaaaatcaggagtcacggtggtggggatccccaaaaccatagacaatgacattgcgattacggaccatactccgggatacggcagcgcggccagatacattgctgccacaactgcggaggtagggatggatgtaaaatcccttcccatccatgtatgcgtgatcgaggccatgggaagaaatgcgggctgggtcacggcagcctcggctcttgcccggaaaaagccgggagatgcgcctcatctcatttatctgcctgagcgtccgtttaaggaagaagaatttttagaggatgtaaaaaggcttcatgaggaaaagggcggcgtggttgtggttgtcagtgaaggattaaagggagaggatggaaagccggtggttcctcccatctttaagacaggacgggctacttattacggtgatgtaagcgcccaccttgccaatctggtgatccggaagctgggcatcaaggccagaagtgaaaagccggggatctgcggacgtgcttccattgcatggcagtcagccgtggaccgggaggaggctgtgctggcaggacgggaggctttaaaggctgccatggagggccagggcggagtaatgatcggatttatacgggaagccggagagggtggagaataccgcatccgtgcggaacggatccccattgaaaaggtcatgcttcatgagaaagtcattccggaaagctttatcaatgagcggggaaatgacgtgacccgggagtttgtggaatggtgccgtcccctcatcggccctgaactaagaaattttatagattttcaagagatcaataaaaatggcttaaacatataaacagaaaggtgaggatcataaaaatgaaacatatttttttgaacttaaagcggtttgacattccccgggaagcaggcggtgtaaattccattgctcccatggaccagtggggaaggtatattgtatccaatacccaggaaaacttaaaaaggtatgaaaatgaggatgtggagtttgccatgtattttccggaggctcatttgattcctgcggtaaatgctttagcggaaaacagcccggtgaagatcggatgccagggagtctaccgtgaggataccgcagttggaggaaattttggcgcttttactacaaaccgtacggcaaatgcggcaaaggccattggctgtaccaccaccatcatcggtcattgcgaggaaagacgagataaggcaggagtgcttttggaagcaggggtgaccgatccccaggcagtcagccgcctgatgaataaggagatcggacaggccattaaggcgggtttatctgtactttactgcattggagaatccgcagaggaacagccccgctggcaggaggtgttaagggaacagcttgagaccgggctttttggtgtggacacctcccgtgtggtcattgcctatgagccggtatgggccatcgggccggggaagactccgccggatggagagtatattgccaggatcggctcctatatcaaggaagtgacaggaggtcttcctgtggtttacggaggagggttaaagactgacaatgcacggatgctggcttccattcctgtcattgacggagggctgatcgccctgaccagattccagggagagatcggcttttatcctgaggaatatctggagattataaagacttatttaggaaaataaagttaaaagaaaaataccttttaaccttgagtttgttaacagcgtgccttgtttcaccgggcatccactggatacacaagcatatccgcttaattcgttcgtatataaaaatcggagaaaaggagaattataaaatgaatgtagcattggagtatggacagggaactgtaaacgtcacattgccggatactgcggatatttttattccgggagagaccgtaccggatccgccttatattccggaggatcagctggaggagaaaacccttgaatccctccgcaatcccatgggcatggagcctctttcaaagctggctcataaaggctctaaagtgaccatcgtatttcccgacagggtaaagggaggagagcagccaacctctcacagaaaagtttccattaagctgattttacaggagctgtatgatgcgggcgtggaaaagaaggacatccttttgatctgctccaacggccttcacaggaagaatacggaaaaggagatcagggccgtgctgggggaccaattattccatgagttctggtatacccatcagatcatcaaccacgacagtgaggattacgatcatctggtagaccttgggacaacgggccggggtgatcctgttcttatgaacaaatacgtatatgacagcgatgtggccattctcatcggacatacccagggaaatccatacggcggctattccgggggctacaagcattgctccaccggaatcacccactggcgttccattgcctcacaccacgtgcccgaggtcatgcaccgggcggacttcactcccgtaagcggcaaatcccttatgaggacgaaattcgatgagatcgggcagcacatggaacaatgtatgggaaagaaattcttctgctgcgatgcagtcctggataccaggtcacgccagatcgagatcaacagcgggtatgcggctgtgatgcagccccactcctgggtcacggctgacaagcgaacctatgtgccctgggcggaaaagaaatatgatgtgatgattttcggcatgccccagtttttccattacggagacggaatggggactaaccccatcatgctgatgcaggctatttcagcccaggtgatccgccataagaggatcatgagcgataactgtgtcatcatctttacctccacctgcaacggatatttccatgacgagctgtggccctatttaaaggaaatgtatgacatgttccagaaagaccagatgaacactctgccggatatgaaccgttacggagagtattttgccactgatgaagaatacatccgaaaataccgttactgcaacgcctttcatcctttccacggcttttccatgatcagctgtgcccatgttgcggagatgaatacctctgccatttatttatgcggagcacaggaaccgggatatgccagaggcatggggttaaagaccagagctacggtggaggaagccctgacagatgcaaagaagaaatttgtggggcaaaatcccaatatcctggtgcttccccagacctttaagctgagcgccgtccatttaatgatgaagggagaaacgcctgacggaaagggacatgaagatagcggctgcatggcccatcatcataaatagggggagctgacatgacgcatgaatattacggatatgataaggaagcgcttttaggagatccgaagatcagactgctttgtatgaaggataaccatgaggtgttccgccagatggctgagcagatggcagaagagataaaaagccgtaatgccgcaggtgaaaaaactgtattcatctgcccggttgggcctgtaggacagtatccttactttgtggatatggtgaatgggggaaatataagcttaaaaaatgtctggttcatcaatatggacgagtatctggatgaggaaaaaaggtggattcccgcagaccatcccttaagctttcgcggatttatggacagaaacgtttattccaggatcagacaggagcttttgatgccaaaagaacagaggatattcccggacccagacaatctctcttatattccagagcttattgaaaggcttggaggggtggacatggtctttggaggcatcggaattaacggccatgtggcctttaacgaggcggatggaaccttaagcgaggaggaatttctggcccagaagacaagagtcttaaaaataagcccggaaacaagggccgccaatgccattggggattttaacggggcgctggaggatatgccgtcttactgtgtcacggtgggcattcatgagatcgcccacgggagaaaaatccgtttgggctgtttccgcagctggcacagggctgtggtcagaagggccgcatatggggagccgacctcagaatttcccgtaagccttttacaaaaccatccggatatcacccttacgtttacggaatacgtagcagcattaaccgactgaccatcatataagacaggagaaataaaaaatgagcctgataccgatgaggcctcttatggaggcttccataaaatatggctttggacagggcggctttaacgtaaatgccgtggcccaggccaaagcagctattgaagtacatgagatgttccgttcccctgctattttacagggggctgatctggcaaatggattcatgggaggaaacgctgattttctcaatgcaaccctggaagataaaagaattggtgcaagaaacattggaaatgcggtgaaaaagtacggtctggattctgaaatccccattgttctccatttagaccacggcagggattttgattcctgtgtggccgccattgaaggaggttatacctctgtcatgattgacggttcttcccttcctctgaaagaaaacatggagcttaccagggaagtggtaaggtatgcccatagcagaggggtgagtgtggaaggagagctgggcgtgctggccggcgtggaagatcacgtattttctgattcctctacctataccaaccctttggatgcagtggaattctttaaaaaaaccggcgtggatgccctggcaatttcctatggcaccatgcacggggcgtcaaaaggaaagaatgtaaagctgcgcagggaaattgttattgcaatcagggaatgcatgaatcacctgggaattttcggcgccctggtttcccatggctcctccactgtaccgaaatacattgtagatgagatcaatggccttggaggaaaactttccaacacggaaggcatttccatggaacagcttacggcggccattggggcagggatcaataagatcaacgtggatacggatatccgtctggctgttacccgcaacatgaaggaattctttgaaaaatatccggaaaaaaggagcagtgagtcaatcggccccatttatgaacggctggaggccaggaaggaagcttttgatcccagggtgttcttgcctcccatcatggatacggtgatgtatggcaccattcctgatgaggataccgctgccattgcggactgcgtggagcgtggggtcaaggaagtggtgggaaccctgatcgtaaagttcggttcctatggaaaggccccgctggttgaatgtgtaactcttgatgaaatggcagagcgttataagataattgataaatggctgtaaaaaagagccggttcagagaaatgtctggatcggctttttgaaatggaggagaagaaaggtatgataaaaaatccccctccccagacttcttttttgggtgtaaactacagatactaaaacactacgaaaaacagagagggaaatggtaagcatgagcagtaaaaaaaagaacagtgtgttaaaccgcattcctgcaaggctgtggatgtttctgtcggttctggcagcgtttctgctttggatcttcgttgcatctacggatgcaggcggagtcatttttgcaaagccctgggaggtagtatcaaaactgatcggaaagctccaggatggaaccttgtggccccacattaccatcagcttgttccgtgtgatcgcaggctttctctgcggctttattgcatcgatccccattgcatttctcatgggctggtatgcgccgtttcggaatctggtggcaccctggatccagttcgtaagaaatattccgcccctggcgtatattccccttgtcatcgcaggggcaggagtgggagaaaaggcaaagatcatcgtgatctttatcgcttcttttcttgtgctggtagtcaccatttaccagggcgtctgcaatgtggatgtgaccttgatcaaggctgcaaaggtgctgggggcaacggaccgggatatattcttccgggtggtcataccggcgtccacaccctttattctggtgggggccagactggggctttccgcttccttaaccactctggtggccgcggagctgacaggggcgtccaaggggcttggaatgatgatccaaaaggcccagggttattacgatatggcaaccgtacttatgggaattctgatcataggcgtgatcggtcttacctttgaacagattgtaagatacttggaaaggaagttgaccggatggcaggagacaatgcagcagtaaaagtaaaaatcgatcaagtggtaaaaacatatagtgcccgcaagggagagatgacggctttaaacggggtcagccttgacataaaggaaaatgaattcatctgtgtggtaggtccgtcaggctgtggtaagtcgactctgctaaacatcatagccggacttttggaaccaacgtctggaagcgtatccgtggacggcaaagcagtggagggcccggggccggagcgggggtggtgttccagcaatacgccttatttccatggctcacagtgcttaaaaatgtggaattcggcttagcgcttaaggggatcaagggagagcaggccagggaagaagccatgaaatatttaagaatggtggatttagagccgtttgcaggagcttatcccaaggaactgtccggcggcatgaagcagagggtcgccatagccagggcctatgcggtaaatccccaggtacttcttttggacgagccatttggtgccttggatgcccaaaccagaacccagcttcagacggaacttttatccacctggcagaaagagcggaaaacctgcttttttatcactcatgatgtggacgaagccattattctggcccaaaaggttatcattatgagtgccaggcccgggcgcattaaagagatcgtggagattgggatcccatatccaaggacccaggaaacaaagatgactccggaatttttggagttaaaaaattatatatggtcccaggtgtatcaggaatatctggagatcaggaaataggaggagaaaggaatgaagaaaaggatttcgttactcatggggatggtaattgcagcagcagctctgaccgcatgctcaggcggggcacagactcctgcaacaacggcagcggagacaaagacagaagagacgaaagcggaggagacaaaagcagaggaaactaaggcagaggaaacaaaagcttttgagaccgcaaagctccgggtcgcttatatgcccaacatgggaagcgcctctctggctgttacggcaaaggaaaaaggctattttaaggaaatggggctggaagtggagatggtggaattccagggtggccctgccgaaatcgcggcaatggcttccggggatattgatatatcccagatcggacacggggcacatgctctctgcgcatcgggggaagcggtgattttccagatcgactgtaccagccttgctgatgctgtcatcggcaataagacaaaaggggttaacaccattgaagatttaaagggcaaaaaggtggccgttaccagcggaacctctgcggaaatcattttgaacctggctcttaagtctaagggaatgacaacggatgacgtggaactggtggaaatggatgccaacggcaccgtatctgccgtgatcagcggcaatgtggatgcatgcgccacctggtcacctggaaccggaaccattatgaaagcccttggagacaacggagtcatgctggcaaataaccaggattttctagaccaggtcacattcccgtcgagttttattaccacacagaaatttgctgattccaaccatgatgttctggtgcgctttgcaagggcccttcaaaaagccggggattaccgggcagagaatattgatgaggttgcaaagttggttgcaaagcagtgtgaggttgatgaggccgtcatgctggcaggcacggaagaaggaaactggctgacaggagaatttatgggaaaagctctgtcggatgggaccatcaaagcctattatgagaaccagcagaaagtattcttagacgcaggccgtctggagcagccggtagatgtaaacaagtatgttctctttgacatcatgcaggaagcatatgatgaaaaccacaaataaaacatatgggtgattgtaaatggaggtatctgtaaataacagggcacctccatttacggcacttaaaatttaaccggatcaagtaagtcccccacttcaaatgcggaaagcattaagtggtgtgtggggacttgcttgtgtcaggtggagtacaagctccacctgacaggcagcgatagctgctattcggttatgagcaagtagcgaagcggagtgcgaatatccgcttgacgaacgatacggggtgaaatcatgctgtttgttgttctgttttttattttatcctcctctatagcgatttttttccttagaagagacaaacagaccaggctgatgctggggctttgcgtcagctttgtctgcatgtttatcgggattatcatttacttatcaaagacaggagggctgcagacagggcagaagtttttcctttttttcgatctcaggatacaaaggaagctgtcctacatggtttttcccttaaagaagctgggatatatgatcgccatgggaagaaccctgtttcccgggtttctgcttatgctggcctttgattattccatgataccctggattcttcggagcaaatcccggcatattttaatcatggtcctgccctgtctgaccttggtcctctactatccctccctgtttttggggctgataaaatgggggaaatggctgcagtttctggccatcaattttacgattttatggatcgcctgttaccttgcggcggctttgtggctgctgcttcatgagtacaaaagcattaccattccctactgcaaaaggcagttccgctatattatggtgtttttgatctgcatggggatcatgtactgcttttatttccgtcaggatcccatccaggtatatcagatgtattccgcagagtatatgcgttttggagggcttctttattccacaacggcaagcggagccgtcagccggtggatgattctgtcggtgttcaccacactgtttggaattctgggattcttaagccttaaatcctattctgtcatggaacatgaggagaccagaggggatgtgatcatccagaagaagatggacatggccagcaagggcctttccgtatttgttcatggcatgaaaaaccagctgctgtccaaccgggtccttcaggaacggatcagggaagagcttgaaaagtctgaccctgataaggggaagcttctggaatattcccatatgcttgaaaccattaaccagaatatgataaaccggatggaggaattatataagagcattaagtccagctacatgaccctggtgccaacggaaacgtcggaggtggtccgcagggttctggaacgctttcatgagaaatatccggatgcagcggtagaaacggccattgaggccaaaaccctggtcctggcagacgccgttcatttaagcgaagccctttataacctggcaatcaatgggtatgaaagcattctggaatccggcaggcaggaaaggcgcttaagcataaaggtgcatcatgagcggctgtatgtgacttttgagatcagggataacggaagagggatgtccaggcaggtccagaaaaagatatttgatcccttttataccagcaagaataccaataataactggggcctggggctgtattatgtgagacagatcgttaagaaccattttggaatgctgaaactggaaagtgcagagggagaggggacaaccttttttgttgccatacccaaatgcaaaagccaggatgaatatggaaggggaataggatgataaaggtgctgatcgcagaggattttaccatactttgtgatgatttaaaaaagcagctggagagggatggggagataaaggtgatcggctgcgcttccaccggaaaggaaatcgtggaaatggccctggagctggatgcagatgtgattttgatggacattgagatggaaaccatgaacgccgggatactggcagccgaacgcatccgggatgtaaaacatgatcagaagatcatttatctgaccgtacacgagaccgaggagatcatcattacggccatgggaaccggggccgtggattatgttgtgaagggaggggcaatcgaacatgtaatagagcatgtaaaaaatgctcatatgggaaagcctgtaatggaagcgagaatacagaaaaccattatgaacgaatacaaacggcttcagcgttctgagcggagcctgctgtattttattaataacgtttcccagctgaccgccgcggagcgggagctggtgaagcttcttttggaggacaggaagataaaggaaattgcggggatccgctgtgtggagatcataaccgtcaaaacccagataaaaagccttttgcgaaaattcggctgcagcagatcaaaggagattgtttccattatcagggaattaaacttatcccatttatttgaggagcaaacgtttggttaaatagaatggaatctttgcagaaattatgatatgatgaaagcataaaacgcgaaaaagacggcggtcttagaaaggggaaaggagaagtttgatgaaaacgttatttaaaaacggacggttttatcagaacggcagctttgccttgggggacttactggccgggaatggaatgatactggagacagggaaaattcagggagaagagggtgccgttgtttatgatctggaaggaaagccggtagttccgggatttattgatatccacacccatggggccgcaggagtcgatgtaaacacggcaacggcagaggattatgaaacgatctgccgtttttttgctgcccagggaaccactgcatggctgggatcagtgcttacggataccagggagcagaccctttggtgtatagaagagtataagaaatggaagacccgggagcataaaggagcagagcttttgggaatccatctggaaggcccattcctttctccggaatataagggagctatgccggagcatctgcttaggaatggggacttagagcttataaaggaataccagaaggcggcggagggggacattaaatatatcacattgtcgccggaggtggagggaaatattgccatgatcccggaattaaaaagccttgggatccaggtggccatcggccattcgggtgctgattaccatacggccaatgaagccattaaagcaggagccagaggggctacccatacgggaaacgccatgaagctactgcaccagcatttcccggccatctggggcgctgtgctggagtctgacgatgtgttctgcgagatcatctgtgacggccttcatctccatccaggaacggtacggctgatcatcaagaccaagggcctggaccgggtggtggcggttacggattccatcatggcagcagggcttcctgatgggaattataagctgggagtgaatgatgtggtggtggagcatggggatgccagactggcttttggcggaagccgtgcgggaagcacgctgaccatgggaagagccttaaagaatattcaggagtatacgggaagacctcttaaggaagttctccggcttttttcggaaaatccggcgaagctgctgggcgtttatgacaggatggggtccattgaggcaggaaaggaagcgaacctggtggtgcttgatgaggactgttgtgttttaaagacgattgtacggggaagagaatgccgctgatgcgggctagaagggacttgaaaaaatgagcggttatttgtacatattgtttctgttgatcagctttggtgcctccgttgcaggggccatctgcggaatcggaggaggtgtcatcattaagcctaccctggacgcatttggagtgctcagcgtatccgccataagttttctgtcgggctgtaccgtgcttgccatgacctgttattctgtgatcaagggaaaaatgagcggagaatccctggtggatatgaagacagggactcctcttgccataggggcggctctgggcggagttgcgggaaagtccatgttccaggctgtttcttccctgtttgcagacaaggatacggtgggagcggtccaggcggcctgccttctggtgatcactctcggaacgctgatctataccataaaaaaggacaggattcacacacatcatgtgacacagcctgtgatctgcgtggtgatcggactggtgctggggatattttcctcatttctgggaatcggaggaggccccatcaacctggtggtgctgttttactttttttccatggatacgaaaacggctgctcagaattccctgtacatcatcctgttttctcagattacagggattctgaattctctcatgaccggaacggttccggaattttccatgggacttctggtgcttatggtggctggagggatcttaggcggggtaaccggccgggctgttaacaaaaggatccatgagagggtagtggataagctgttcctggttttgatggtgatcatcattggaatcaatctgtataacatttatcagtttatgtaagccgcggggctgttgcggataggatccgtttcagctctttttatgcggacaaccagccaagtgaacatacgaatctgttatcaggaaaggagatctgatggaacgaatatttgttgtggccctgtcagctttgctgggaggttttgcccaggctgtcacaggctttggaggggcgatcattatcatgatttttcttccgctcatcctgtccatgaatgcggctcctgccttaagtgacgtaatcaccatggtgctgtccttttccatgttctggaggtatcggaagtcagtaaggctaaaacccattctccttccggccggaatttatctggcggccagcacagctgccatccactggtctgcgtattttgacgggaggaagctgaaggggatctttggcctgtttctcatagggctgtccctttacttcttctttttttcaggaaaagcaagagtaaagcactctcctttcgtgggagcggtctgcgggcttgcggcaggaatatgcggtggtttttttgggatcagcgggccgcccatgagcctttattatctggctgccatggagaaaaaagaggaatacttagggacgctgaacgcatttttttccattacggtggtttttaacatcatcgccagaatctccaatggattcctgacaaagaatctgattccctatatgggtgttgggatcgtggcgatcctcgttggaagcacctggggcagcaggctggtggagcggatcgaccgtaagaccatgagcatgtgcgtttatgggcttatggcagtagccggaattgtggctgtgctgtaagaaacataaaaaagaggaaggggtatcttgacaaaggtttagaaatatggtaaataactaatatacacacgagtttacattgaaaagtattgtgcaatatttcggagtattggagggtaaagatgaaaacaaaactaaatgcggggtttgtcaccacctattccggcaggtggcccatggaggtcccggaacagagaaaccgggaatatggggactggctggccgaaaacctgcctatggcccggatcataagggcttctgtcttaggctgcagccgggaaacagtagagcaggttacagaggaatttaagaaacaggatgtggatgtaattgttctggtttatggtgcgtttacaggagatgatgtggcttcctatctggcggagatggtgaaggtgccgatcattttatgggcgccctatgaggtaccatttgaaaaggatgacaggctttattccaatgccctctgttccatgaccatgaacgcggctgcaatcagaaagctgggggcctcctatcataccgtatacggaagcctggaagatgaaagggcagcggaaaaggtcaaaaatctgatcagggcctatggtgtggtcaaagccttaaggcacaccaatctgggacttttgggataccggcctacggccttttataactgcagctttgatgaaagcctgatccgcaggacctttggggtgaagatcgaagaaaccgatttaaaggtggtgtttgaccggatggaagggctctctgaagagggctggaaggcggacatggagaatatgtcctcccaatacgatacgacccagctcccaaaggggcatttggagaaccattccaggctgtatctggctcttaaggaggtcatgaaagatcagaaatatgattttgcggctattaaatgctggcctgaaatgggaaatctccatgcaaccccctgtgcagtccttggacggctggcagacgaggggatcaacatcggctgtgagggagatgtggatgcggagctggcacagatgacggaatactatcttacgggaaagcccagctttattactgacttaatcaacattgatgaaaaggaaaatgtgatcaccttctggcattgcggaaacgctgctccgtctttatgcaaccaggactatcaggtccagatcagaaatcatcctctggcagggcagggcactgcgttttacggagccttaaagcccggagaagtgaccattgcaagattctgcaacatagacggaggctataagctgtttctcatgagaggagaggcggtgcccctggaccggtatacaaaaggaatcatggcaaatataaaggtgaaacgccctgtaagggaagtcatagaaggaatcatcgcagaggggatcccccaccattacagcattgtgtgggaggatgtggcggatgccatgaagcaggtatgcgccctgttggacattcctgtcattgaaatgtagcctggaaataaacgttgacaccatttgtaccgtccgggtataatgagaaatatacatacgagtttatagtaaggagacgggacaatgggtcagaacggcgaacgggtgacaagatcagatgtggcgaaggcagcaggagtcagcgagacgatcgtatcctatgtgatcaataataaccgctatgtggcaaaggaaaagcggcagagggtggaagaagccattgcagccctccactacaggcccaataacgttgccagggctttgaagggaaaacgaagcaaccagcttcttttcattgcggaccagatcaccaacgaatatttcagccggatcgtcagcgaaatggataagtacgcctatgaggccggattcctgatttccctgtgcgccaaccggaatacgccggaattcgtttctcaggtcatcagccgccagtacgacggcatcatcatcagctctatcagctttcccatggagtatgtggagtccttcagcagagcgggaatcccggttttgctgtttgagcacagaactcatggcaggcttccggaaaatgtggctactcttgcttccggcctatattctggagccagaatggcagtaaagcatctggttgacaggggaaagaggcatatcatttatattgaccgaatcagcagaaagggaaatgtaagcggtcctacggatctgcgtttaagcggatatctggatgagatgagagaaagcgggctttgggccggtgaagacacggtgattgcgggctgccactcggaagaggaactggcggaggctgttgtaaaatatttaaaggctcataaggaaaccggcgggatcgtagggcggaatgatatggtggcctgcatcgccatgtacgcggctgtgggttatggaaagagagttccgcaggatatgggagtggtgggatttgataattccagcatcagcaggttttgttttcccaggcttactactctggaaatgcagcgggaggccataagcaggacagtcattgatatgatggtccagatgatcggaggaaaacagccggaaaatgcaaagtttgaaacaaggctgattgtaagagaaagcacataaacgttttattttggggaaaaacacagattaatccgggaggttatacacacgagtgtacaaagggaataccaggctgatattgcccccggtaaatctggttttaatagaacaaggcgagtcataaagaaagagagggtattttatgaaaaaaagaagactagcagcgttggcactggccggtatcatggcgctcacaaccggttgttccggcggaggaaagacagaagcagtcacatcagcaggggagacgaaagcagaggcaaaggcagaggcagaaacaaaagcccaggattcaggaagcaaggagcccatcaccttaaagattgccaattatgcggtgctggaaaaggggtatgatgagttctggaaaaatgtgaaggaaggttttgaggcaaagtatcccaatgtgaccattgaatgggtcaccgctccctacggggaaatcttaaaccaggtcatcaacatggcaggcggcggagaccgggtggactgtgttttcagtgagatgatctggattcctgcgctggtggatgccggtcttgcggctcccatgaaggatgtggttgatgaagactttttaaatgactattatcccaatatcctggaagcccataaggttgatggagaggtttacggcgtaccgctttacgtgtctccttcccttttgttctacaacaagaacttatttgaaaaggccggccttgatccaaacaagccgcctaagacctatgaagaaatgctttccatggcggaaaagctgtcagggctcactacggacgacggaaataaggtatatgcattcggtcagcccactgcatcagtaatcgttatcggatcctccattcaggcctttgccgcaaacttcgggggttatgtctttgatgagaacgaaaagctgaatgtggaaaacgaaggcctgaaggaagctcttgaaatgctgaagcttcttgatgaaaaaggctataatccccagaatgccaagccaaaggatttgagaaacttatttgccctgggacagcttgccatgtattatgacaattcatggggctttaacggtgccagatccatcaatccggaagtggtgaactttgcagctgcagcagagcctttaaagggcggaaacggagatggagcttccaccttacaatcccattgttttgtagcggttgacaacgggccggaacgtgtggaagcggtaaaggactttatccagtacgtgatcacgccggatattttaaatgactatattgccaatattgccccggcccttcccgcaaaaaatgccatgaaggacatggaagcagtaaagaacagcccgattttaaacggagcaggaaattccgtggaaaaggcagagccggtactgatgttcccaaccctgtctgattttaacttagagctgtgcgcattggctcaggcggtaactgtagggggagaagatgtggacactgccctgaaaaacttccagaattcagtgcagcctttgcttccgtaacaaacggacagtgatttaacttcatcaggcagcaaaggggattgcgaatatcccattggctgaaaggagagaagatggcaggaaagagaccaaacattgtatttattttaacagatgaccaggggatctggtccctgggctgctatggaaatcgggaaatcaggacacccaatttagaccggctggcccaggacggcgtccgctttgataactttttttgtacctccccggtctgttctcctgccagggcttctctcctgacaggaaggatcccgtcccagcacggcattcatgactatttaagcggcggcaacgggggctgcgggcaggaggccattgaatatctgaaagaatacaggggttatacggatattctggcggagaacggatatacctgcgggctcagcggaaagtggcatttaggagacggaaggagacctcaaaaggggttttccttctggtattcccatcaaaagggcggcggaccttattataacgctcctatgttccgggatggggagccagtgtgtgaaaagggctatatcacggatgtgatcacggatgaggccctggcctttattgacagggagaaaaataaggaaaatcccttttatttaagcgtccattatacggctccccattccccctgggtcaacagccatccaaaggagtacacgagcctgtatgaggattgtctgtttgaaacctgcccccagtctgttccccatccgtgggctaagacagaggtgctggacgggtataagaattccagggaatgcctcataggatattttgcggcgatcaccgccatggacagtaatgttggccggattttggaaaagctggatgacgaagggctgacagaggacaccatgatcatttttaccagtgacaatggctttaactgcggtcatcacgggatatggggaaagggaaacggaacatttcctttgaatttttacgattcttccgtgaaggttccctttcttataagccataaagaccatattccggaaaaacgggtttgccggaccatgtgcagcggctatgactttatgcccactcttttagaatatctgggccttgagaatgaggaagaggataagctgccgggaaaaagctttttcaatggccttatgggtgttgaggaagaaacggaaggtcctgtggttgtatacgacgaatacggcccggcccggatgatacgtgataaacggtataagctggtccgccggtatccatacggcccggatgaattctatgatctggaatcagatccgggagaagcatgtaaccggatccaggatgaggactgcatggaagtgatcggccgtatgaaaaaacagatggaactgtggtttcttaagtatgcggatccaaggatcgacggttccagagaaccggttttgggcgggggacagagctgtatggccggagtcctgggtcctggaatcaatgtttacggagagaacaaatagaaagtggggaaaaaaccttgaaggagaaggcaattaagaggtcgtatgttaagactcagacgggagacaggatatttgcttttgcactgctgcttcccgcgattattacaaccgcagcattcatattgattccggtggcggattccatttacagaagcttttttgattataaggtaaagaatattatttcgggaaaaccgggagtgtggaatgattttgccaactacataaagcttttttccaacggaaagctggttccttccatgacaaataccctgatgtttgtgtttggagtggtcaccgcccagtttgttctgggaatggccctggccctgattttaaacaccaatataaggttttcacgttttatccgcagcattatgatggtgccctgggtggtgcctacccttatatccggacttgtctggctgtggctgttccagccccagtatggcctggtaaaatatttcgcaggagtcctgaccggaggaagggtgactaatctggcggttttaaataatccctccacggctatgctgggcgtatcattggcagccttgtggaaacagattccccttgcagccctccttcttttggccggccttgccaatgtgcctgaggaaattctggaggcagctaaaattgacggggcaaacggggttcaaagattttttaacattgtgctgccctatatgaagagcgtgatcaaggtcacggtttccatgtccattattgagaacttcaaacagttccccttattctggaccatgacagggggcggaccaaataactccaccaccaccatggccatattaagctaccgggaagcctttgtttccaacaattttggctccggagcggcggtcactacggtatggatgcttctgatgattgtggtggtatttatttataaccgcatttttcggacagatgacatgtaaggaggaggcagaatatgaaacgaaaccgtaccttaaacaacattctgaagtatgtggttttaggcctcatccttttgttcctgctgttccctcttttatgggttctgatcacgtcctttaaaaccaatatggaggcatataaatttccgcccacctttctggtgaggaatcctacgattcaaagctacatcaatttatttactgttgataacgacttctttacttattataaaaataactttgttgtggcaggaagcgccgcgctcatcaccacctttatggcggtcatctccggctatgccttatccaggttccattttaaatggaacaaatggatcgtggcggcatttacttccgcacagatgtttcctgtggtcagccgtttgatttccctttataaaatccttggggacgttaaactgattaatacccatccagggctgatcctggctgttacggcgggcatgctcccgttcaccattatgctcatgtccagcttctatgacgggattccaaaagagttagaggaagcggccagagtggatggagcgggcagattcgggaccctttttagggtcgtggtccctcttgtaaagccggggatgctggcagtgggcatttatgcattcctgctttcctgggatgattatctgcatgcttccaccctgattcagacagattccctgcggactctgtcggcaggcgtggcactccgttatctgggcgagctttcctatgactggtctctgatcaataccatttccattgtgggcaccattcccatggtagtgatatttttcttcttccagagatatatggtcaagggcctggtagcgggtgccgtaaaaggataaaaaaggagaaaaaaccatgcttgtaacgaacaaagagaatttaatgaaagcggcaaagtcaggatatgccattccggctcttaatacacagggaggaaattacgacatcatctgggccgcctgcagggcggcggaggaaatgaagtcccccatcatacttgcccattacgtatccactggggcttattccggcaacgactggtttgcagaggtttgcaaatggtgtgcgggcaaggtatctgttcccgtatccattcacctggatcatggcgcggattttgatatctccatggaggcattgaagctgggtttcacttctttaatgatcgacggctctgcaatgcctgtaaaggaaaatgcggccatgaccaatgaggtattaaaggtggctaagtgctttggagtgccggtagaggctgagataggagagcttttgcgccttgacggccagggggctgttatggaaaataagaatattgtggatcctgaggaagtaaaggcgtttttagaactgtgccggccggattccctggcaatcggcatcggcaatgcccacggatattacaggggagagcctgatattcatctggaggttttagaggcggtgaggcggtttacggatattcccctggttcttcatggctgtaccggaatgaaggaggccatcatcagggaggcaatcaagctgggagtggcaaagatcaatttcggcacggagatccgttataaatatgtggagtactacgaagacggcttaaagaccatggatcatcagggtcattcctggaagctgtcccagtatgccaataacaggctgacagaggacattaaggacatcatccgtttggcagggtcagagggaaaggcctgatttgtctgataagaaaagaaccgtttgagaggagttttgacatggaaaagaaaaacagccagttgacttatgacgaaatatacaaacagccggaatcatttgaagcggtcaacaggacattggatgagatttataaggtcctggatcaggtatttgcggaaggatacgaggagttgatctttaccggctgcggcaccagcttttatctggcacaggctgccgcccatgccttttccgcttacaattcaataccggcaaaggccgcgtgctgttccgagctttattattttccggagacctttgtgaaaaacagaaaggtcctggttcttcccatcaccaggaaaagctataccaccgaagtccgtctggccattgataaagtgagaagctttccaggggtaaaaactctggcaattacctgtgacaaggacagcgaagcctataatgattatgtgatcctgtctccggatactgccgaggacagcgtgatcatgacccgttcctttaccagcatggtctatctgaccgtgatcatggccatgtatgcgggagggaaaaaggatgaagtgtctgccatggcggactatggaaacagtgcaagagacgcccttaagaaaatggatgatctggcaaaaaaaatcatccgtgaaaatgggaacctaaacttatacattaccctggggcaggggatttattacggggtagccaatgagtgcatgaacaagatcaaggaaatgggaatatcgaattcagaggcgtattacagcctggaataccgccatgggcctatgagcctggtggatgagaacacgctggtccttttcttgagccaccgggagacagaaaaagaggatgcaaagcttttggttcagatgaagggatacggcgctgtgacggctgtaatcggaaataccgtctctgctcatatgaaggaggcagattactgcctggatctgccctatggatataacgacatgcagaatgcggcgctcataggatttatcgggcagtttatcggttattatattgctgagaaaaagggcattgatgcggacaatccaaggcatctgtcccaggccatcgttatccagtagcttttctcttatagagccgctgcagaatgaaaaagccgcctgccgttctgttatatagagggagatggtgaaattcataaaaccagggcagcccgtcgctgaattgactcagagaccgggctgacctggtttttatgtaaccctattcttcctttattaattgctccagaaggtttttagccataagaatatccgttttttgttcctctccggatatttcccgctctatggtgatatctcctgtatatcctatttctttcagctttgctacaaaagcaggatagttgacctttcccatgccaagaggcacttcctggcccagcatgtggccgtctgtgggatagtttccgtctttgccgtgaattcccattacgtattccccgaacacatcaagggcgtccaccggatttgctttgccgtacatgatcagattggcaggatctaaattgatccctatatttccttttcctgcttctttttctatatcctgtatggctctttttaacgtaaccggagtttcctgtcctgtttcaaaaagaaaattctgctgattctttttacattcctttaccaatgtttttaagcacgccagaacgcccggataattgggatcgtagggattttccggcatgtaccccacatgggtcaccacatcccttacatgtatcatggctgcaaaagcaattcccttttccagcatcttcatcctttcaaagcggaaggcctcaggcacaaggcccagagtaagctgcccgtcataaaaatcccagacttttgggccttcccagccgcaccagaaggctgtgatatccaccttgtgacgatctgcggctgtgtttactttacctgcaatgcgttcgttcatcaattcctgatcccagcataccagctggcagctttccatccccatggagcgcagctccgcaaatttttcatccacatccgtatcccggaaaagttctaccataactccaattctcatgggaaatccctctctttctttttattaacccttgacagctccggccgtaatgcctcccacaatgtgcttctgcatgatcacaaagaaaatcaggcttggagccatggacatgacgattcccggaagggcgtgttcccagtccgccgtctgggcggaaaactgcatataaagggcattttgaatgttcatggccttggcattgcctccgacgatcagctggttggtgatgatgtcattccatatggcaagggtatccagaaccaccaccgtggtcagaatgggctttaacagcgggagaacaatggtaaaataagtcctcacctttgatgcaccgtcaatgcaggcacattcctccagctcaatgggaacattttttacaaaaccgtggatcatatagaccgctaaaggcatgcacagtcctgtgctcaccaatatgtatcctatcctgagtcccgtcatgccaaggctggcaaccagcctggtgagagtgatcatgtaggactggaagggaaccatcataggcatgataatgagtataaagcataccgaggacaatctgccctttgtccttgccagcttataggctgccatgggggccagcagtgtgatcattgacaccgtacacgccgtatacagcagggtattgctgatgagcatgggaaaacggaattttgtccaggtttccatgtacatgtttaagctccagctttcaggcagggccaggaacttttgaagcatgtcgttgtagggtttaaaagaatttatgaatatgagaagcaggggcatcagccagaacacggaacagatgaacacaacagcggaaagtacgctgattttcttcatttttttcattacgcctcaatctccttaccctttgttaccttaagctgtattgccgtgacaatgagcacgaacactacaaacaccagggatttagcagtagccattccgtaccggttgttcataaatgcttccttatagatattgtacgccacggaaacagtagaattggccggcccgcctttggtaaataccatgatcacatcaaacagcttaaatgaaaatgtcagggaggtaagcatacagatggacactgcgggcatgattaagggaatagtcacccttttcaacacctggaatctgctggctccgtcaatttttgcagcctcgatcagctctcttggcacagaaatgattcctgcaatatagtttaccatatagaatcccagattctgccatacggtcatgatcaccaccacaaagaatgacagctttgctgaacccagccagctccagtggaacacctcccagccggttatctgatataaggcctcaaatcccggtccaagaatgaatttccagatcagactgatggccgtcaggcttatgatatacggtatgtaataaaatgcccgccccacacttgagcttttcttctcctctgacatgacaagcgccaccgtcagggacaggatgttcaccgccaccacataaaatactgcaaatcttagggtaaatgcggcgcttttccaaaacagtgcatcgtttgagaatatattaacgaagttctgaaggcccacaaacttcatgttcttactgattccattccaatcaaaaacagagtagtacaggttcatcagaaacggtatgtctgtggaaaaaagcacaaaccctaccgccggaaatacaaacaatgcgaatattaacagatcttttgctttccctttgtctttcactttcacgcctcccaatttccatttccatcaggccgtttaagcaggagattagtttttctgagcctgccagcctttctggaattcttctgtcacctgctccgcagtcatgtcaccgatcatatatgcctgaatggcagggcctacgatatcggaatatccgttgggtgctatggtgtggatccagccgtttgtcttgcctttttctacgtatgatgccgcatcgttagccagggcaccctttacttccatggttgtcttggctcccggaacacctcctacgccttcgcacatccatttctggccttcctctgatgtgaggatgtattccagatattcctttgccaggtctaaatgcttggaatccttgttcacaatataggtccagttacaggaggagagaagtgtggcgtcttccggattatcgcttaccgggcaggggaggaatgccaggcgtgcattggggttaaaggaatccagggtggactggcaccagtcgcccatttggatgatggctgcctgcccgttagccagcatattttcacttgtttcccagtcgatttcaaggggcttgtcagggccgtattttacagccaggtccaggaagcggaagaggttctggaaattcttcatgtccgcgaattttaattcgccgctgtttaatttctccacaactcccttggcgtccagagatttatccatcatgaaatgggtggacaggtgatgaaggacccaggtttcttttccggccagggcaaatggtgtgataccggcagcggacagcttctcacaggctgcttcaagctcatccatggtagccggaagctctgtgatgccggccttttcaaacagttccttattatagatcaggcccatattttcataggtccagggcagggacatgatgtttccgtctgcgtcctttccggtttctaatgcggcctccttaaatttgcctaatacctctttgtccccggaccagttataggcatattcataatacttctgggctgctgtgccggactccacatcaaatacatcaggaatatcccctgaattcacacgggactgaagcagggtgctgctgtcgtttgcagcgtgctgcacttcaatctttactcctgggtgggcctcttcaaactttttggccatctccgcatactcttctaagccgtatgcgtgggcatcaaacacctttaaggtgatctcctctgccgtctttgcctgatccttggagacgcttccgctgcatgccgtaaggccggggaccgctaatgcggttgtcatcaggattgccaatgctcttttcatcataatttttcctcctaacatataaaaacttttatggttaccttttattcacgtattcctttgcctgtttccattccctgatcgcctgccgtaccgattggatgccttcttcaagaggggcgacttccacaggctttccttcctgaagacattggataaaatattttatttccgtataataaggtcccagattagagatgttgatcccggccgaatcatcgcttacatcatactcccgttgaagctccggatgctggatccttccgtcattcctatagatggtcagagagggtttttcccttcccttaaataccacgctggcttcctcaaagcatgcgtggaagctggcctcaaaaggaagtgcagagcttacatcccatatgccttccgttatggcaaacactttgccgaattcataggccgtgaagatctgattgatcatgccgctggaaaaggctgtggcccttacgtcaaaggaatcaggctctcccagcatataccggagaaagtctaagtcatgaacgtggaggtctaaaaccacggaaccgctttttccttcctcgtggaaccagtcttcatatccccaggcggcatcaccgctgaccctttgcatggtaatggatttcagttccccaaacctgcccgtatcgtagcattcttttaaataccggtattcgtcgaaggatctcaccacctggcctaccattacctgaacatggttttttctttgtgactccagaagcttttcagcctcttcctctgtcagacatacaggcttctccacaaatacatggatccctttatccatagccgccagcgcatgctctgtgtggagatagctgggaaggcagatatgaacgctgtccagggtttccccttccaaaagctccatgcctgtctggtacagccttgcctttggccattgaattgctgccttttccagaaattcgggcctgcagtctgccagggccgtcacttccacattcattttcgttgacagcgctttcagcgacaggttgtgagtcgtgcccattccgccgcatccgatcagtcctacattcattttatcatcctcttttcttagtttgtacagtgaccttactaataaaacttaaaattaaaagcctttccggttaaactgcaaaatttcggcttttaatttgagcaaatctcatttatttgttggttttacaatagcattaagtgacatatatgtcaatatacttttggatctcacatgaatttaatgtaatttacgatatttgagacgatatatagttattaattttatatattatgcatatattatagatattaatcatgtggatttacaatttattgtcactggttctatgggagctcttacaactacaaagataaaaagtaagtttttgagagaattattttgaatttttcaaataatagggcgttttattgtatttttacgaggattattgcaactgatcattttttatgataacattatttaataataccgctttactaaataagccatgaggaggtgggggaaagcttcgtcttcatcagatcacgagaagcgctggagtgaagtatctgtgtttttctttggggcctgaaaatgatcctggatgaaaaaactacttaaggtgcggtattccggagctttatgtgccccttttccggacaggccgggaaatatgagcggcagctgaatcagtattttatcataacaagcaaaggacaggcaggatattatgaaacttgtaaaccagcagttaattaagaatacaaatatgaagcaattatacaattccatataccgggagccagggatctcaagggcgcagcttgcaaaggattcccgtttaagcaagactgcagtttcctctctggtagatgaattgattgcccgtaaatttgtatacgattccggtgccagcggaagtacgaatgtgggacgaaagcccaacagtctgctgcttcgggcggaacagtattatgtggccgttttttttctggaggaaaagagactgaacgcggccctggtggatatcaccggatctacatccttttatgaacagatggatgtgccctcccctgatgactacattccaatgtgtcaggaatatattcatcagactgtgctgcagcagatcggcaaggagcagtttctgggaatctgtgtggtggtacccgccatgattgatcctgacaggcgggagatatttgccacaaccttaaatcttccggagaaagactttgtgggccagatccagcgggcattctctgattttcctgttgccctgttaaatgatacggcctgttttgcctacgcagaaaaggtctacacccagataacagaaaaggatttcgcttttatcaacttcgggaaagggatcggcgccaccctttttatccgaaatgagatgctgggccgtgccagtgcttcctatacccagttcggtcattattccattgaccccgagggagagctttgctcctgcggaaacaggggctgcctggagctgatgataggagaggcttccttaaagggccgtatttccaaagcagggggcagcccggctttcagaaaatcatccgccgttacttatggaaaccttgggcaggccagcgtgtatggagatgtggtctcctgtaaggtggtacgggatattgccgatgagttttccatggctttgtgcaacttgatttgtatggtacatccaaagctggtcatcatcggaggaaagggaaaagaccttggacccttattcctccaggagatccaggagtgcctgcgtaccatggggttccgccgcatggtaagctctgtcagcgtcaggtacagccttttagattccagcgctctgtataatggcgccatgaagtattttttagatatccattataattttactcaggatatggccggaagcttttttatcggctgagtcaagttttccggctattgtgttttcttataaaacggaggtatgccagtggaaaagttaagagctgcaattatgggctgcggaaggatctctgcctgctatgaggacgcttttcgcagactgtcggattatgtggaattagtatgtgccatagacattgataaagacaaggcaaaggcctttggggaaaaattcaattgccattactgtacggatctggaaaccgcgatgcaataccgcattgacgtgatccatttatgccttccccattatcttcaccctgtcatggccataaaggctatggaggcaggagtacatgtgctgacagaaaagcccatcgcaatttctcttttggatgcggatcagatgatggatgcggagaggctgacagggaaaaagctgggagttatttttcagaccaggtatacgaaaagtgtagaaaagttaaagcagcttattggtgagggctattttgggaagattttatctgccaggtcttatcttacatgggaccgtcccggctcttattatgagggaagcggctggaaagggacctgggataaagaaggcggcggcgtcctgatcgaccaggccattcacagcatggaccgggtgcggtatatgcttggcagcgacattgactggatcgagggaagtgtacacaaccactgccatgaaatggtggatgtggaggataccgcagaggcagccatccggtttaagaacggctgcatttataatctttacgcctgcaattcctatgcttttgatgcgcctattaccatagaattccagggagagacggggcgctgcggcctgatacaggacatggggttttatgaagctgatggatgctatacggaaatccggaatacatatgaaaccacaaatgttgggccggattactgggggagcagccaccaccttcagatcagggacttctatgaatccattctgtatgataagcctgtggctgtcggcggactggagggcaggaagaccctggaaatggttaaagggatctatttgtcttctctggagaggaggcgtgtttatttgccatttgaggatgtgtattataaggatttgaatattcaaagggtatgaggtgcacaaagagcttggaggttatgagcgaatagcgaagggattgtgaatatccgaatgacaacgatgatacaggctgcaggaaaagccgtgtttcttactgcattaaagaattgaagaaaacaaggattaaaaaagggataactgctgaggggatcattccatcccctcatgcaacagtccctttcattgccttcctgtatttccttccgcttaatctgtcatcactgttttaacccttttattgaaagaaaaagccgacacacggccggctttacgtttctggcatgatttatatcagaacaatttttgcaaggaggaaaatgttagaaataagcatacgatgtagcaaatcgtcatgcagattcttaaagcagtgggagctttatatccggccgttgtatcttttctccagatcattaatacaataaaagcgcctgataccggtgtggcaatagcggttgccaggtttgcaatatatattaactgaaccggagagcctccaaacataaaacagattaccgctgaaacggccaaaacaacaaaggctccgattttaatgcttttatcctctaatgaggtgggcttatcaaaaccggcatttaaaagtaccacacctctttgggtattaccaagcagagaggaaaaacctgcacctagaagtgcgattcccatgatcggtctggcaacacttcccataacaggaaccagcatttcagcaagctccgcaggtgattttactatagttttagtgggattcagtacaatcgccgcaaccagcatgacagctccgctgatcagtattacacagataacatgagcgatggaatctgccaataaggttccgttaaacaagtcttccttcttccatttcttttcactaccaagataggtgccataaattccggtagtaagagctgcatgggtgcttaaaaatcccaatgcagtggccatacttccttccggaaacctccaggccgaaagaccctttgccattgcgctcacgctgggaccgccggtgccgaccagggtaatataaaaagcaacaatcatacccaatacacagataccaacacctttttcaatcttagagtaaacccctttagaaaaatagcagtatatgagtacgcaaatcatgatcattgcgcctagtttccagtcgatgccaaacaccagctgcatacctgcgccggttcccgagatattacctatcgtaaagaagcagcaagtcaaaaataatgcaaagcctgtaaaggctgccgccccttttccataatactttcttatagcatgaatcgttggcatacctgtcagcatagaaagtctgtatgtaaccaaaacataagttgaacccataaaagctatcaggatataaagccacaaaaggctgtagccgtattgggcaccaatcatcgatgcagttgtaatcgcccctggtccaattacaataccggtcagaataatccctggtccaactttctttatcaattccccaaatgtcagtttcttaaccgttgaaggatcaaaagtttctgcctccgcgttagcaatatttaaatgattcatagtttgtcagcatggtttttaggagaaccataccaccctcccttctcaacttccccgaaatgaatacagatacatggctatcggcttgctgctgcagacagaaagccgatttgcccttaaaatatgactatttctcaaatttgctcatatcaatggccggcagctggctgtgtttaagtcccagtgcaacccagtctttttcttcctggcccagcggaagtactggcttacgcattaaggctgaagtgaatacctttctctgaaccaatgcttcttttaaccgtgcatgagcctcaccggatggctggccgccgccgtaaatagcctgggagatgtggtaaatacggtctgaccacgcctgtgcttcttttaaagtgtggctttccggatccttgaatacttcccatgccggacaaatcagctcgggtacgcaccctgcgaatccgatcagagcgccatccattcccgggaaccagctgacacacagagtctcatcatggcaggtgatcagagaaatatccgggcactcctgacgcagtaagcgtacatcatgttcatagatagaagtaacacgggtccccatcttgatgcactttacatggtcaatctctttgcacattttgatcagagtctgtaccggataatttgccttgctggttgccggatagagatggatgattatatcgatatcagctccttccgcaacatcttttatgtactggaacggagcatcatcgctcatgccgaaacgcagccacatatgaggtggcatcagcagaattccgtctgcaccggcttcttttgcttcttttgccatttcaattgattcaattgtgttctcgcagttaatacctgagatgatggtcatgatatcgccgcattcttcgctgcagatttcaactacacgtttccgttccgcgcgggaaaggccggtaatctctccggtatggccattgcataccaggccctgaatgcctttgtcataaaagcttttgatccagcgaagataagcgcggaattctttttcattaatagagtagtcatcctttaatggaaccgatactgccggaaagattgtcttaaaatgttttacttttgccataatatgattctccttataatttttgcctttttcttttccaagcactgcgcttatgcttttgatttcatacaaacgtttgcatatcttacgattatgttatatcatgccctagtatttacgtcaatatcacatgaaaaggctgcaataatttgcatatcatatgcaatattttgcatttattcattaaagtatagagagaataacttgggtttttggtgtttttgtttactttatatcttgtattccattggaatgttggatataattcttttgtactaacgtttgtatataataaaataaggagtgtgaaagatggcaactttaaaagatgttgctcgtattgcctgcgtcgatgtcagtaccgtatcacgggcaattaacaatacctcatatgtacatcctgatacaaaagcccgcatatttgcggcagtaaaggaactaggctatcagcccaatgtcatcgcccaaagcctgcggcagggaaaaaggcataccataggagttgttgttccccgtctgcatatgacagtctttgctgaaattatgcaggggattgaagaagaagccagacgattaagatatgccacgctcatctgtaacacagaggatgatccgaaaatagaacaggaatgtttaacccggctgcgcaatggttttgtcgatggtattatcattgccggaacaggccacaacggccgcctgcttcgtgatatccgttccagtggtctgacaattactcagatcgtacggcagcaagacagtacgattaacagcgtcattgtcaattatgaaaactgtggttatgaggccacaaaatatttggcagcaaaaggctgccgggagatcggcctgatcaacggcaccatgaagctcgctccttatcaggggcggtataatggttacaaacgcgctttgacggaactgggattggctgaaaccagtgccatctccacttctcccgtcaacagtctggaatacggctaccagtgtgcccttgatctgctggaacaaaatcctgagcttgatgctattatggccgctgtggatgttcagggcattggggccatgcgcgccttaaaggaacgaggtatcaaggtccccggccagatccgtttgatcagccttaccggccatgttattggtgcaatgctggaaacaaccatgacatccatggaaatgccggcacgtaaaatgggagaaagggcggctcttatgacaattcatgatattgaatctcccgcagaccaaacctcatctccccagcaccttgtgtttacgtcttcgctggtagaacgggaaagcagttaatatagttaatctaaatttttccctgccccttatgtgtccagtgtgtcatagtatttttacggtcgcctatcctttataaatgaagaaaatctttattttactaaaattatgctaaaagctgccgatatacacactatgaatataaaaacaaaaacaaggggtgtagtacaaatgggaaaacgggaaaaacagaattcaattgtccttagcaaaaggctggcaataggattcggaatagtaaacattataacggttttaatttctttcataagtcttttcaccatttacagattgtattttgcaggcagtgtttcatcagggattgttgcacttttttcagctgcagtggtggttctgaccgtcgtatctgttgtcgcaagtttcataatatgcaggatcttaaacggaagcattgtgcgtcctcttaaaatactcaacaatattgcgcgtcagatgtctgtgggagatgccagtgcaaacgtccgggttctcacaaaggatgaagtgggagaattgatgaaatcttttaaggagatggtggaaaacaccagaaaccaggctcagacagctgaagcaatagccggcggggatatgactgtccacgtgaaggtaaattcggaaaaggatgtcctgggcattgcgttaaaaagcattgtagagaaaaacaaccacattctgtctcaaatatgtgatacatcggggcaggttctcagcggggccggacagatatcggaagcaagcgtacgcctttcggaaggagcaagccgtcaggcaggttctcttcaggaactggcggcagctgtgacggaggtaaaaaaccagatcagcttaagcgcggatcatgcggcaatggccaggacatgtgcaaatgatgtcaggcacggggccgtggacggcaacagacacatggatgaaatgctgaaagccatggatgaaatcaacctgtcctcgtcaaatatatcaaaggtaataaaggcgattgaggacattgctttccagacaaatttactgtcattaaatgcctccgtagaggctgcaagggcaggccagtacggaaagggctttgcggttgtggcggatgaggtgcggagcctggcggcccgttcagcagaagctgcaaaggaaactgcagacatgattgaaagctccatacagaaagcagagcatggaatgacaattgcaaagaccactgcagatgctttcagcaaaatagtgggagggatagagcaggttgccggtttggcagaaaagatcgccggagcatcgtcagaacaagcttccggaataacacggatcaacgacgaaatcagccaggtatccgacgtggtgcaggcaaattcggcagcgtccgaggaaagtaccgccgcaacggctcagctgtacaagcaggcagaggcgctgaaggatatggtgcagaccttcaaactgaaaacgccttgctaaagagaagggtgctgtccaatagcgatgaatcgctattggacagcacccttttacgtttatcctttcaatctcatgaaaaggcccttgagcctacagaagaatgatgttatgcttcttgcattcctcccgcatttcctccggccaggtgctggcctgaacttctcccacatgggctctgtccagaaggagcatgcagagccgggattgtcctatgccgcctccgatggtgtagggcagttctccgtttaaaagcattctgtggtaaggaaggtttctccgctcctggcagcctgccttctccaactgctttgccagggattcttcatccacccggatgcccatgctggagatttccagggcgcagtttaaattctcaaaccagaacaggatgtccccgtttaactgccagtcatcgtagtccggggctcttccgtcatgaggctctccgctttccagcttgtccccgatcttcatgagaaaaacacagccgtgctcctttgtgatcaagttttcccgttcctttggagtcttgtccggataccggtcttccagttcctgggaggtgataaaggtgatatcctttggaaggtgtttcactgcctggggatatttgtaccagacttcatgctgcatgtgcttgatgatcttgaaaatggtgcggacggtttcctttaaggtttccaccttcctctcttccttggtgatgactttttcccagtcccactgatccacgtagcaggagtggaggttgtctaattcttcgtctctccggatagcgttcatgttggtataaaggccttctcctggcagaaagccgtattcatgaagtgccatgcgcttccatttggcaagggaatggacgacctcaaccgtttcccccggaatgcctgcgatgtcaaactgcaccgggcgctccactccgtttaaattatcgtttaatccgctgctgcgctcaacaaataagggagctgagatacgttccagattcatttcctttccaagctctttttgaaatgtatctctaatgtatttaatggcctcctgggtctcccggacagagagcctggggtcatagttttccggtatgatgagttccatgtggtattttcctcccaaataaaatgtttttattatggtatcactaatatgaaaaacgtgcaaccattgttttatattggggaacaaggggaaagcttttggctgccggcaaaaaagttgcatggagactggccctgtgatatgataaatggaagtgaaaagaaaagagcagagtgatatgacaacggaacgaattattatagaagataaagaaaatccaaaggaagaactattaaaaaagcctgcggaaattttaaaagcaggcggcctggtggcctttcccacggaaaccgtgtacgggctgggggcaaatgccttaaatgaagcagcggcaggaaaaatttatgcagcaaagggaaggccttcggacaaccctctgatcgctcatataggagattttgatgatctgcctcctctggttctggaaatcccggagacaggaaaaaagctgatggaagccttttggccggggcctttgaccctgatttttcctaaaagcggtttagtcccttacggaacgaccggaggccttgacacggtggcagtgcgcatgcctgcggatccggtggcaagggccctcattcgtttggcaggggtgcctgtagccgcgcccagtgccaacacctccgggcgtcccagtcctactacggcagaccatgtgtggcaggatatgaatggaaagatcgatatgatcgtagacggaggggcagtgggaatcggcgtggaatccacgatcattgatgtatcaggggctgagcctgtaatcttaagaccgggagccatcacccaggaaatggtttctgctgttctagggaaagaggtccctcttgatcctgccattatctccggtccaatgaaggcggatgtgaggccaaaagcccccggcatgaaatataagcattatgcgcctaaggctgagctgaccctggtggagggggatgcagagtctgttgccgggaccataaaccgcctggcagaagaaaagctggcccagggattccgggtggggatcatctgtacggaggaaacaaaggaaaagtatcatgagggaatgatccggagcatgggaatgcgggccagggaagagaccatagcccataacttatacggagtgctgcgggaatttgatgatctggaagctgacgttattttttccgaaagcttttccagggatcacttaggacaggccattatgaaccggcttacaaaagcggccggatatcatattttaaaggtttaaaatcataagagaagagcgccttgcgggcataccgttatgcccaagaagcatgggaaagaaggaggaaacaccctgcgggtatacctttatgcccaaaaggcgtgagcaagaaggaggaaaacaaatgtcgggaaaaagagaagattatattacatgggatgaatattttatgggagtagcggctctttcctcaaagcgttccaaggaccccagcacccaggtgggagcctgtattgtgagccaggataacaagattttgtccatgggctacaacggttttcccatgggctgctccgatgatgagttcccatgggacagggaaaatgagaaggacgatccttataatgccaaatatttctattccactcacagtgaattaaatgctattctgaattacaggggaggaagcctggaaggcagcaagctttatgtgaccctgttcccctgcaatgagtgtgccaaggccattatacaggccggaattaaaactattgtgtatggttcggacaagtacgagggaactccggcagtcaatgcatccaagcggatgctcaatgcggcaggggtccggtactatcagtatcagaccacaggaagaaagatagagatcgaggtttgacatgaaatttctattggtggcgcttaacgccaagtacatccattccaatcccgccatttacagcttaaaggcttttgcagaggcctatgtaagggagccggaactggaggatggaaggtttcagattgagactcaggaatataccattaacaatcagcccgatgagatcttaaaggatattttcttaaggaagccggatgccgtgggattctcctgttacatctggaatatttcctatgtattagagctggtccgggaccttccgaaggttctccctcatgtggagatctggctgggaggtcccgaggtgtcttatgatgcttctgaactcctttgccgggaaccccaggtttatgggatcatgatgggggaaggggaggaaaccttttcggaggtggtgcggtgctatataaaacagggcagggatgctcataaaagcgacgaaagctgttcctttaaaaacatagatggcactgctgtaaggaatgaggcaggaactgtggtggaaaaacccaaaaaggcagcagttgacatgagttccatcccctttctttacaaagatttaagagggtttgagaaccgcattatttattatgaaagcagccgcggctgtcccttttcctgcagctactgcctttcttctctggataagtccgtgcggctgcgggatacgcagctggtgctgaaggagctggatgtgtttcttgataaaagggtccctcaggtgaaatttgtggacaggacctttaattgcagcagaaagcataccttggcgatctggcgtcatatcattgagcatgacaatggggtaaccaattttcattttgagatttccgcagatcttttaaatgaggaggagctggagctcatgtcccgtatgaggaaggggctgatccagcttgaggttggagttcagagcaccaatccggataccattaaggagatccgcagaaccatggatttaaaccgcttaaaggaaacggtcggaaaaatcaacagtttcggaaacatccatcagcacctggacttaatcgcaggacttccctgggaggattaccaaagcttccggaattcctttaaccaggtttatgagatgaagccggagcagcttcagcttggattcttaaaggtattaaaaggctcttacatgtgggaaaaggcgggggaatacggggttaagtttaaaggtctgccgccctatgaggtgctgtctaccagatggctggattacggagggattttaaagctgaagggtttggaagaaatgctggaggtttacggaaacagcggacaattccggacgaccttaaatgaacttcaaaaagagtttaaaacaccttttgatatgtttgaggcattagccgaatattatgataaacaggagctgtcaggaatcagccacagccggatggccaggtatgagatattggaagggttcatttccagtctggtaccggaaaaacgttccctgtaccgggatcttttggtatatgatctttacctgagggagaatttaaaaagcaggcctccttttgcggcggaccaggagccttttaaggaccaggtgagggcgttttttgaggcagaggcggctggataccggtatttaaaggaaggatatgaaggctatgaggcaagacagcttataaagatggctcatgtagaggtattccgggatggaagagcagtcctttttgattacaaaaggcgggatgccctgtcccataatgcggcggcttatgagcttggagtatggagaaaggctgaaagagaaacgtctttcagccgttagtttgtgaatcaaccggatgggtgggcatatccctttgattcatcaggaggaatttaatggcaaagagagagacaaaagcagagcggcaggcccgggtattaaaggtgcttgaggcccttgaccgggaatatggaacggattatatatgttatttaaaccatgaaaatccatggcagctcttgatagcggttattttaagcgcccagtgcaccgatgccagggtgaacatggtgacaccggacttgttccggaaatacgattctccaatgaaatttgcccaggcggatttaaaggaattggagaaggatatccattctcttggtttttatcatatgaaagcaaaaaacatcatatcctgctgccaggatctggtggaaaaattcggaggcgaggttccgcgtacaatggaggaactgacctcccttgcaggagtgggccggaaaaccgccaatgtgatcctgggaaatgtgtacaacgaacccagcattgtggtggatacccatgtaaagcggatttccagaaagctgggctttgcaaaagaagaagatccggagaaaattgagtatgagctgatgaaggtacttccaagggaacactggattttgtggaatatccagattattactcttggcagatccatatgtgtagcaagaaatcctaagtgctgccagtgctttttgcaaaccctctgtcccagcgctggggcgcagtcacagaaaaaggaggcttaatttggtatcatcctatattgccgtagatttggaaaccaccggccttgatcctaagcaggataagatcattgaaatcggagcagtgaaggtggtggatggacagataagggaaagctacgagacctttgtgaatccttacagaaagctggatatccgggtgatcatgcttaccggcatcaacgaccgccagctggaggcttctccggggatcggagaggtgctcggcgggtttctgaaattcgcagaaggcttacccatccttggacatcatgtaatttttgattacagttttttaaagcgtgccgccatcaatgaaggtcgcagctttgagcgccagggaatcgacacccttaagcttgccagaaaatttatgcccctgatgagaaaaagaatttggcggcggcctgcgaatattttgggatcgcccagactttatgtcaccgggctcttgcagatgcaaaagcagcccatgggctttatcaggaaatggcaaaacggtacggagaggaatcgccggaagcttttggctctcaggctttgatttataaggcaaaaaaggaacaaccggcctcaaaaaggcaaaaagaacacttgcaggatttattaaaatatcataaaatagttttatctgtgcaaacggaacatttgtccagaaatgaaatatcaagaattacggataaaatcatagcacagtatggaagaatataagagaggtgataccgtatgattaactttaacaataaaaacaacagaaaatttttatcagtagttttgatcctagtagtcattttgctgattgttgccatggtgcttccgatgatgcttcagtttatgtaagcggcccaggaggtttattggcagcatacaggcacagcagcagagcatgaggaatgaatatgaaaaagaaaactttgtccatgagcctggctgcaattatattagcggcgggaattggatttctctctcccacccatgtcatggctgataccctgccggacgggatatatgtgggagaatacaatctgggaggtatgacagaagaagaagccagccaaaagatccaggagctggtaaatgagatggaaaatcagaaaataacgttgattgttgacggacagccggtagaaaccgtggcaagagagctgggttttcactggagcaatcccgaggctgtaaaccaggccgcttcatcctggcagggaggcaacttaatcaaacggtatttgaataaaaaggatattgagcagaaccatgtgatcattcctctggaaacggcccttgacgacggaagggtgggagcttttgttgcggaaaaatgtgcacaggccatgattgaaccaaagaacgctaccattgtccgtgacaaaggggcatttattgtgacgccttcagccattggaaaaaccgtggatgtggcggctaccaagcaggctttggatgcggcccttgccaatgggcttaaggagccggtaacggctactgcagtggttacagaggtgaagcctgcaatcgccacggaagatttatccaccataaatgatgtgcttggaaccttttccaccagcttttccaccagcggcgcttccagatccaaaaatctgcaggtgggagccggtaagatcaacggccgcgtgctgatgcccggggaaaccttgtcaggctacgaatgcatgcatccctttaccctggaaaatggttatgccacggcatcagcttatgagaacggccaggtggtggacagcataggcggaggcgtttgccagatcgccaccactctttataatgccgtactcagggcagagctggaagttgcacagaggcagaaccactccatggtggtaggatatgtaaagccctctgaggatgcagccattgcaggtacgtataaggatattaaatttaccaacaattacagcacgcccatttacgttgagggctatactaacgggaaaactcttacctttaccatctatggaaaagagaccaggcctgcaaaccggacctttgagtttgtttccgagaccttaagcgtaacagatccgggtgcacccaaggaagtggtggatcccgccatgccgccgggaagcagaaagcaggttcagtccgcgcacaagggaatgaagtccaggctgtggaagatcgtttatgtggatggcgtggaacagagcagagagctccttcacacggatacctataacccatcaaaagccattattaaagtcggtcctgccgcgccggcagtagccgtgccgtcagagactcccggggttccggcagaaacaccgccggtggtaatgcccctgaaacagctccggcagagactgggaatccggggccgggaacggtccagatgccgggtgaggtttcacctgaggcaggaccgggagtgtaggcaggtaagatatgagatggattgaaagggaaaacgccggaaccttaagaccagggcaggatcttgttgttgcaggatatgccggtctttggggaacggtagaaaccgtaaaaaataaaaaagaagaattgtatcaatggttttccagagattatgtggacggtattttggaaaacgggaacattgtgccggatggtgacctggaaaagtggaaaaaatttggtgcggcggaatgtgaacctgcaggtgagggcggaatcttaaaggctctttgggatttgtccggtgcttacatgacaggaatccggttttctttccacaggattcccgtgaaacaggaaaccattgagatttgtgagcggtacgatctaaatccgtaccgccttttctcaacaggctgtctgcttttttcggcggataacggaggggatctggtacaggctttaaaagagcaggggatccatgccgctgtgatcgggaaagtgacaggaggcatcaaaagggtcattgaccacggggaaggtgtcggttatcttgaccgccccacagaggatgagctttacaaggtcttggcacataaaaaggaaacgccctgcgggcatacctctatgtccaaaaagcatggacaataataaggaacgccctgcgggcatacctctatgtccgaaaagcatggacaataataaggaaatcaggaggcaggatatgagagaaaagatattggcaattatcgaaaaaaacagcaggattgatttaaaggatctggcgattcttttaggtgaaagtgaggccgccattgccaatgaaatcgctgaaatggaaaaagaacatatcatatgcggttaccataccctgattaactgggataataccagcgacgaaaaggtcgtggcgctgatcgaggtcaaggtgactccccagagaggcatgggctttgacaagatcgcggaacgcatttatcagtacagtgaggtaaacgccgtttatctcatgtccggcgcttttgattttacggttttcatagaaggaaaaaccatgaggcaggtagcacagtttgtatcggaaaggctttctcccatggaatcagtattgagcactgcaacccattttgtcttaaagaaatacaaggaccatggaactgttcttgctgaagtgacaaccgatgaaaggatgttgattacgccgtgagaaatccattatcagatcgaatcgtagagattccgccttccgggatccgcaagttttttgatatcgtcagtgaaatgaaggatgccatttctctgggcgtcggagagcctgattttgacacaccatggcacatccgggaggaggggatttattccctggaaaagggccgcaccttttatacttccaatgcagggttaaaagaactgaaagtggaaatatgcagctatttaagccggcgctttgcggttacatatgatccggaccatgaagtcatggtaacagtgggcggcagcgaggccattgatattgcccttcgggccatgttaaacccggggatgaggtgctgatcccgcagcccagctatgtttcctacgttccctgcagcattctggcaaacggcgttccggtcatcattgatctggaagcaaaggatcagtttaagctgacccctgaaaagctgcttgagaagatcacttcaaagaccaaggtactggtgcttcccttccctaacaaccctacgggggctgttatgaaggccgaagagctggaggagatcgttaaaatcgtaatagagaaggatttatttgtaatatcagatgagatctatgcagagctcacctacggaagtgatcataccaccattgcttcatttccggggatgagagacaggactgtgctcattaacggtttttcaaaatcctacgcaatgacaggctggcgtcttggctatactgccgctcccagggtgatcttggagcagatgttaaaaatccaccagtttgccatcatgtgcgcgccgaccaccagccagtatgctgcggtagcggccctgcgtgaaggagataaggatgtccagatgatgagggaatcctataaccagaggcgccgttatttaatgcatgcgtttcaggaaatgggtatggagtgctttgagccttatggtgcattttataccttcccctccatcaaacggtttggcatgacctctgatgagtttgccaccaggcttcttcgggaagaaaaggtggcggtagtgccgggtactgcttttggagactgcggagaaggatacttacgcatttcctatgcatactccttagataatctcaaggaggcattaaaccgcatggagagatttgttaaaagactggaggaaaaagcgtaaggatatgaatattgtattattggaaccggaaatgccagccaatacgggaaatatcggacggacctgcgtagcaacgggcacaaagctgcatttgattgaacctttgggctttaagctcaatgacaagctgatcaagcgtgccgggctggattactgggataagcttgatgtgaccgtgtacagcgattatcaggactttctggacaggaatccaggtgccaggatttatatggcaacgacaaaggggcttcatgtgtattcagaggtggaatatgaaccggactgctttctgatgtttggaaaagagagcgccgggatcccggaagagatccttttggaaaatcaggaccgctgtgtcaggattcccatgtggggagatatcaggtccttaaatttatccaattctgtttccgttgttttgtatgaggccttaaggcagaacggatttgaacgcatgaccatgacgggtgaacttcatcaccttcagtggaaggaataaaaaataccgatacagttttttcttgtctgtccagaggaaaaatgtatcggtatttttttatacgctgacaggcagtccccggtcatggcgattctttcgatgattcagtattttcattattaaaagacttggaatcaggctggttcggcctgattccaagtctttttaaaatagtattttcctgtctcggctgcagtaaatattatcgcgattttatatgtgagcggattatgatgagaacaatattcttaatgatatagaaatatcaagtagacgtaaatggaaagtaaaaagtcatttttcgcaatatccaagtattgatatgaatagacaaaaaaataaagtttatataaaatttatataaaggttcctgcgtaaatggagtttgtatgtgagatattaccatataaccatttgcatatgtcaggaaaaacactatatcacgttgatggaggaatatagtgatggttactttgcaagttttgcactactaataaagatacatgaaaaggaggttattatgactaaggatagagctgtaagatcggggcaaatgtacctgtatttaaaaaggtactgggggctttacttattgttgctgttgccgattgcatattttatcgtttttaaatacatacccatgacttacatccagatcgctttcaaaaagtataacataatgcaaagtgtatgggagatggaaagcgcgaaacaaggaggatttgaatattttatcaaggcatttgccaatcgggatttcttttatgcggtacgtaacacgctgctccttaacttcttagatttgctttgcggatttccggcgccggttatcctggcacttttgctaaatgagctggcttttaagaaattcaagcgcctgacgcagaccgtggtttatatgccgcatttcctgtcatggattattatttccggcatagcacttcagctctttgcccctactgacggtctggtaaataatatcatcaccgccacaggaggccagccgatccatttccttgatgatcctgcccattgggtggttatgtacgtgatattgggaatctggcagagcgtaggctggaatacaatcatttatctggcggccattacaggtgttaatcctgaactgtatgaagcggcgtctatcgacggtgcgaaccgcctgactcggatctggcacattacgctgcccagcatcaaaccaaccattattgtactgttgatcatgaatttaggccgtatcttaggcagtgagtttgaccggccctacgccttagggaacaatctggtgacaagtgtggacaatgtaatcgcaacctttgtttataccaacggcatacgcggttcgcagttttccctgaccactgctgttggactcttccagtctgtgatctgtgttatcttcctgctggtttctaactctctggctgaaaaatttggtgagcaaggggtctggtaaggagaacgaaaggaggtaaaaaaatcgtggtaaaaagccaaaaaacaaaagttatggattatcttatcgccgctgtctgcggcctgattattatcatctgcctgctaccggttatccatgtggcggcgcgttcagtcagttctcctgaggcgcttatcagaaaagaagtactgctgctgccgaaaggacttaattttgatgcatacgtcaaggtcctgggcgactcgaaatacatctggtctctgtgctttaccgcaatcctgaccattgtctgtacctttgtcagcatgtgcatgacaatcttttgcgcttatccttttgtctacaaagacttaagagggcgaaaggtttttaatactctgattatttttacgatgtacttcaacgctgggaccattccgaactatctgcttttaaaagatatgggactgttggaaaatccgctggtattaatacttccgaactgcctgagtgtctttaatgttattattatgaagagttttttctatgaaattcctgagagcctgcgggaggcggcgcagatagaggggtgcggggtgctgcgcacgttatggtatgtatacctgccgctgtccaaaccagtcatggcgacgctgtctcttttttatgccgtgggtcgctggaatggtttctccgatgccctgatgtttatcactcgccgccgggaactgtttcccatacagcttctcttatataatctgctgaaaaatgtgtcatcaatagaagcggtctcagaaggcttcacggcgccgggagtttctgagtctgtgaaggctgccactgtgatgctcgctatggtaccaatcttagtggtctatccgtttttgcagaaatacttcatctccggtgtcacattaggaggcgtgaagggttaattaagcaggagctgtttcacctgcgggaatgagggattcattcctggattccggcgcataggcgaaaattccaatacaatactttatataaagaaggaggaaaatatgattcacatagctgtagtaggactgggcaatatttctggaaaacatttgcacgggcttttactgtttcctgaaaggtgtaaaatcgtcgctctttgtgatatttatcccgaaaaagccgaagccgctaaagaaaaatatggattgaagggggcacgggtttttaacgaccatattaaaatgctctcttctgagctgaaaattgacctggtacatatctgtaccccgccctcgtcccatgccgaaattgccataaacgccatgaatgccggagtaaatgtgctggtagaaaaacccatggctccaggtcttaaagaatgtgacgagatgctggaggctgaaaaaagaaatggcgttgtgttgtcttgtatctctcagaatcgcttccgcaatcctgtctggcgcctaaaaaagctggtggatagtgggctggctggaaatatactggccgcccatgcagattccttatggtatcgtggacattgctactatgatctgtggtggcggggcacctgggaaaaagaaggaggcggtccaaccttgaatcacgcagtacaccagatagacatacttaactggattaaaggggaactgcctgaagaagtgacctctttgctggccaatgtggcccacaacaattccgaggtggaagatctttcattttcggcattcaaatacgctgatggtacggcggcggaggttacggcttcggtggttcaccacggagagggacagagtattgtccttcaatgtgaaaaagccaggattgctgcgccctggagtatcgctgccgatgttacccagaacaacggatttcccataccggggggcaatgctgttctcgaaaaagaattgaatgagtattacgataagatagagcccttagtttacgaggaacacgatggagaaatagatgatgtgcttacagctttagaaaagggaacgcggccgctaattagtggggaagacggaaaagggacggttgaactgattaccgctatgtatatggcagggtttgaaaagcgaacagtcaagctgcccattacaccagaggatgaatattataccgccaatggcctgatgaggcacgcaccgcatttttacgaaaaaaaagccagtattgagaatttttcctatactgatattattcctacaggagacatggggaggacgaaatgagtgtaaataaagttgatggaatgaattatgcaccaaaaggaaaaccgagccccgtagtaaaggagggggaatttgtcatagcagcgattgcattagaccatggccatatctacgggatgtgcaacggactgacagaggcaggagccaccctcaaatgggtatacgatcccgatgaaaaaaaggtagaggcttttttgacggcattcccacaggcgaaagccgcaaggagtgaggaggagatcttttctgatcctgaagtgaagctgatcgccggggcggccattacttccaagcgctgcgaattgggcttgcgggtactggctgcggggaaggattattttacggacaaagcgcctctgacctcactttctcagttggaagccgccaaaagggctgtggtgcaaagtggaaaaaagtatatggtctactatagtgagaggctgcacgtggaatcagccgtttacgcaggacagcttattgaacagggtacgattggtgaggtggtccaggttattggcatgggaccccatcgattaaatgcctcctcccgcccggactggtttttcttaaaggaccaatacggtggaatcctgtgcgatatcggctctcaccagattgaacagttcctctttttttccggggcaaaggatgcgagagtggttcacagccaagtgggtaattacggacaccgggagtatccggaactggaagatttcggcgatgccatgctagtggccgataacggtgccactcattactttcgtgtggactggtttacgccggaaggactgcgcacttggggagacggccgcacctttattctcggtacgaagggttacattgagatccgaaaattcgtcaatgtgggtacggaggatgaggttggaaatcacgtctatttagtcaatgaggagggagaatttcattacgcggtggaagggcaggtaggctatccgtttttcggaaagctgatcttagactgtgtaaaccgcagcgaatacgccatgacgcaggcacatgcttttaaggcggcggaattaagtatattggcggagctgaatgccgaaaagatcaagtaacacaaggggagtttcctatgaacaggatttatgagaaatttgaagaagactgcaaatgcgattttaaggatatagtggctgtggagcgggcttaccacagtcatgacggctttgaggtctatttatttttagacggtgagattaattattatatcgagcaatattgctatcctttgatgggaagtgagctattgctcatcaatccgggagaatatcaccgcgccgtactcttaaatactgtgaaatacaagagaatgacactgaacgtcagcgtaggtatactaagagagctctcggatgctgagacggatttgtcagattgcttttcgaacgctaaaggtacaggaaaggtcctgcatttgaatacccaggagctgcaaagctttatctttgcagcaaaacaattggagacggccctgaatggagggaccgcttacggacatgggctgttggctaaatcctgtctgcttcaggtgcttgtgcagttaaaccggctgtttttaatggcgggtaagaaaaagattgagaacacgatgcctgcgctggtgcagaaagttatcgaatatgtagagcaaaatttgacagacaatatcaagctggacgacatatcaagcagcctttgctttaattctgcatatataaaccggcagtttaagaaaattacgggacttaccatagggcagtatattctgtgcaaaaaggtggatttggctaagcggtatctgtgtgaaaaccactctctaatggaggtgtgtgaactctccggctttaacgattactcaaatttctcacggacttttaccagcagggttggctgttctcccagggaatatcgaaaataagactgaggaataaatggaaggtgttctggccacagccgctttttgcgtggacgtgcccggcctccgctaagggggctgtttcattataaaaaggaggagcaaaatgaaggataaacagtgcttaatgatagtaggagttgtattggcttttgcgttgaccgcatgcagcaagggtggagagagaacggctgggaatgaaccggatccgtcgcagaagactgccgcagctatggacagcggcaaggcaggggtccaccaggaactcgatggtgtgcgtatgaaagagaagacaaagatcacagtggaggtttatgaccgtgccaatgacggcggttccaagccggaggataatttttataccaattatatcaaagaaggaatgctgcgggatcataatgtagaggtagagtttatacccgtacctcgctggacggagacagaacagatcaacaatcttttagcgggtggttctgctcccgatatctgtgtgtcctactcctatccggtggtttccacttactcagctatgggtgcagtcgtggatatggcccccattcttgaagagtataaggatgttttaccaaatctttgggaacttttgggtgaagagaatttgtattataataaggacccgaaaaccggctcaatatacgcaatagagtctctgcgggccaatcaggccactttgtgcacctttgtacgggcggattggctcaaaaagctgaacatgaaagaaccgacaactctggaagaatttgagactatgctgcatgcttttaaggacaatgccgagatgctgttggggcggatgcagcaaagatggtacctctttcctatagctttgatgccggatggcgtgctcagcccttagtaggctcctttgtaccgacatctatgaccgaaaaggattattacatcaatagttttgccagtgacagactgatgacttatcccaatgttaaagaaggataccggctgttgaacaaatggtataacgatggactgatatggaaggatttcgcaatttatcccgccggagaccctacagaggataatatgattaaagctggttatgtaggcgcttccattggtcctaactgggattacccttacagaaacggtgaagattccatccaggcaaatatacggcgcgccaccggagatgaagaggctggaatgattgcgattgacccctttcaggatgatacgggggcaaggcgcaaatatatctacagccccgcagggactgacagaaaaatatttttcccggctacaaataacgaacctgtggcttcagcactttacttagactggatcagccaaatggacaatcgtttatttttacagttcggcgaggaaggcgttacctgtgagacacagagcgacggtgcggtcaaaaccttgtccgttaccggcgagaaaatcatgaattccataaacaatactgattatactcttacgatcaacgggctgaagatgaaagatgaggaaacaactctaaaaacggtggccttgggttatgatacggtttcctctgatgttatcacaaaagcttattacgcttcaacgactgatggctttgctcctaagcactataatctgggagatatagaagcggaagccggtatagaggaatctctaagggtaaaaagggatgcgttcttagatcaggctgtttcagcctctgtggataaatttgatgctatatttgacagcggttttgctgattacctggcaagcggcgcccaggccgtcatcgacgagcgcactgataaatggcaggagttttttggagatagcaccagcggaaagtaatattcaccgtttgagttattaagcgggaacaagcacctctgtttttgacaggggtgcttgtaatttcaaagaccatagtcgggatttagaaaagagagtaagtacattagctgtcttatttctttgtacggttcaattctctatgctatggagttccggccttaggaaggctgaagatgaattccgatccaactccttccgtgctgaccacatcaatattttcaccgtgggactggatgatttccctgacaatggcaaggccaagccctgtccccttcttatcctttcctcttgataagtctgtcttgtagaaccgttcccatatctttttcaagctttcctttgggatgccgattcctgtgtccttaatggaaacaaatattttctcatactttgccgaagcctgtatgtagatggtggaatctgcatggctgaactttatggcattgtcaatgagattataaaggacctgctgtattttaccaaggtccgcataaaccatctgaatactttcggaaaaggttaagtcaaagttaatgcttttttcgctgcaggtcccttcaaaagaggctgccgtatctttaataacccggttgatgtcaaagctggtacggttcaaataccctttgctgtccagggaattaagggtcagaagaccctgtgtcagcttattcagccggtccgtttctgaaatgaccctgtttaaatatttctcatacatttccggcggtatggttccgtcaaggatggcttccagatatcccttgatggaggtcaggggagaacggaaatcatgggaaacgttggcgataaaggttttctgataatcctccatcttgcccagttcagcggacatgtagttgagcgtagcggccagatagcccatttcatctctcgtatgcacttcaatgtggtgtgcgaaatttccctgggcatattcatttgccccggctgtgattttcttaagaggaaaatatacattttttgtaaagaccaggaggatgatcagggataagccgaacaccgccgccgatgtaacatagacgatgtttaagatcccatctctctccagcctcaagtaggacaagggaaggtggatcaccacatagccatgggtggtatagttccccgtaatgggagcatggacgcttagtacatcataggaaaactgatgataatagtcgccgataatataggacttgttgcccatggaggtagggtcaaagttttcgatgatctgtccctgtttgtcagactgagcgctgtctgatactaccttgccctgccggtccacgatccatatctgtgcgtgaaggtaattggcttccttcacaagctccggataggaagaggataagttcatatcctttccatggtacatgccgctgtaggaggaggcaatctggttagcctcatcatacagggcctcggaacggcggccaaggagatactggtccgtgatctcagaagaaaaggtggcaatgatcacaaatccaaggaggccgaacaacagatagcccaggatgaatttatagtagagagaatgtgtcatctagcgtttcacctcaaatttgtagccgatgccccaaaccgttgtaagggcccagcctgtgtgatccttgatcttttcccggagacgtttgatatggacgtcaacggttctggtatcaccgatgtattcatatccccagatgtggtctaagagctgctctcttgtaaacacctggtttggagaggaagccaggaaataaagaagctccagctcctttggcggcatctcaatggaatggcccatatagatgacggaataattcgtaaggttgacaatgaggtccggatactccacgtaatctccctgatggtccgtatggagggctgcaggaacaggagtggtctggtagcgccttaagacagcctttacacgggccaccagctctttggaatcaaagggcttgatcatatagtcgtcggcacccagctccaggccaaggaccttatcaaagacctcacccttggctgacagcataatgatgggaacctgggaggaggatcgcatctcccggcagacctgatagccgtccataccgggaagcatcaggtccaaaagcaccagattgggacggaattccgggaacacccggagcgcctcctctccgtcgcctacgatttctgtttcatagcattcttttagcaagtatagggaaattaattctgcgatgttgctgtcatcgtctacgatcaatatccgctgtttttctgccataatggtcccctttctcaaatgattcacgcaaaggcaacgagccgggtggatatgcctgcaagatatgttacttgaatgaaacgatggttactccggaatccccttcgccaaaggcgcccagccggaattcctttacatattttaatttctttaaatgcttgtgaaccgcattttttagggctcccgttccgcgcccgtgtaccacacgaacctggggaaggtgggccagataggcatcgtctaaatatttgtccagttggggaatggcttcatcagtggtcatgccgatcaggttgatttccggtgagatggaaaaggacttggacatacgggtagaactgcttccgcttcccgttttccttgaaccgtttccggaaggggtggaaaccgactcctcgtggagcagctctaaatccgaaaggttgaccagggaacggagaattcccatctgcacatataaatcacccttggcattaggcagggagctgacggtcccgtttaagttcatgcttaagaccttgacgccgtctcccagcttcagctttttgggatcgatctgcttgccgggctgttttttttcatttttcagggaaagggtggaatccacatcctgaagcttgtttcttaatttgcttcgctgggcttccagttccttgctcacgcctgagtctgcggccagcttgttgatgcttcttatggtctggtctgcggtgtccttggcatcccgcaggatcctttgtgcttcctctttggcctcccgtatcatatgatcccggcgttcgtcaagacgttcttccttctgggtcagacgggcttttagctgctccacctccagtttataggaagcgatctggatccgttccttttcaatggtgacccggttttcttctaagtgggtcaaaaggtcctcaaaggtttcatcctttgcttccagatggttttttgcatcttcaatgatataatccggaagtcccagctttttagaaatggcaaaggcgttgctctttccgggtacgccgattaaaaggcggtaagtaggcttaagggtctccacgttaaactcgcagcaggcattttctacgcctggagttgtaagggcaaatacctttaactcactgtaatgggtggttgccatggagcggcatttcatgttgtgaaggaatgacaggatggagatggcaagagccgctccttccgtagggtcggttcctgctccaagctcgtcaaataagcagagggaattgctgtctgcctgttctaagatatggacgatgttggtcatgtgggcagaaaaggtgcttaagctctgctcaatgctctgttcatctccaatatctgcaaacacctcgtcaaacaccgccagctcagagccgtcaaatgccggaatatgaaggccggactgtcccatgagggtaaataagcctactgtctttaaagagacagtctttcctcccgtattagggccggttacaatcaaaaggtcaaagtcccggccaagatgaatgctgatggggactaccttggaaggatctaaaaggggatggcgtccatccttgatgttgatgatcctgtttgtgttaaatattggttcgctggcgttgtaatgcctggataaggctgcctttgcgaaaataaaatccagttttgtcaggatttcaaagtctgtttccagctcctcaagataaggagccagctggttgcttagatccgcaaggatcatctcgatctctttttgttcctggatttccagggcccggagatcgttattaagctttacgattgccattggttcaataaatagggtggagcctgtagaggactggtcgtgaaccatgccggatacctgggatttgtgttcggatttcaccgggaggcagtaacgtccatccctcatagtgatcaccgcttcctgaagataggtccggttggaatttaatatggagtttaactgggtgtgaatcttgtcgttaatggatcgcatggagcgtcttacatgatgaagccccgggctggcgtcatcgctcacttcctcttcggagaggatgcagcgtttgatttccgtgttgaccggggtaagcggttccagcatccggaagaattcctccagagagtcttccggcagttccgagtcttcatgacggccgtatgcttttacccgggctgaggaggtaagaagggagctgatggaaagaatctccacgatccccagggcgcttcctacgtccaggcgctttaaggaaggccggatgtctttgatgcctccaaaggagatgctgcctttctgacggactcttgtggctgcatcggtggtttccttctgagcccttacgatctcatgatagtccgttgaagggaccagattcttacacagctccttgccggaatcgcaggacgcgaactgggtaagctgtgcgatgattttatgatattctaaagtttttaatgctttctgattcatatgttataccttgtttattctgctttctttacactgtggtccggtgatgatggtatctgttacagtatagcatatatgggacgaaaactgcaatcctcaggttgcttttcctgccagtcatattttacttagtatgattcatttgttattcaaatatcagcaggagcgggcattgctttataaatccggacggaacaacgttgtgtatttagtataacatcagacagtattttatgtataggtgcacaaatccatataaaaggtttttggtctttcatgagccggtaatgcagaaatcttgaaagatcattgggctgaggggccaaagttctcatgtttttcttgcataaagggacgaaggaccttataatagtatttaggtcttctgcaaaggagggttagtatgccggaaaataacgggccaggcgatagaaagacggagccacgtcggtttatcaatgaaaagatagtgagacagcccatgtcaaaaagggatatgcttaaaagggctttgggcctttttgcgactgcggttattttcggaatcgttgcagctgttacatttgccgtatcccggcctgtcgctgaaagattttttgaaaaggaatccaccagtgaaagtgttcctgtgaccataccaaaggatgaccctgaaacggtgcctgctgaggctgagaccgggtctacggcggctgagacggaacctattgaagatattctaaagtccgccatggagaaatatccattttcagtggatgatttaaataccctgtatggaagccttcggtctttggtccaaaagtcggacaaagggatcgtgacggtccattccgtaaagacccagacagactggtttaataactctgtggaaaattccagcttgttttccggagtgatcatcgcttctgcaaatcaggagcttcttgtgctgaccccggatggggcagtggaggatgcagaggctatccgtgtggcgttttccgatgggacagaggttcagggaaccgtcaagcagaccgacaagctttccggaatggcaatcgtaagcgtttctacggctgacttaggaagggctttgctggaggaagtcaaggccattgagctggggaattcctattccgtgaaacagggggatctggttgtggccgttggcggccctgccggcatggttcattctgttggttatggatttatatcgtatataacgaaaaacgtgcaggttacggatggagtaacccgcatcctgtattccgatgtgaaaggaaatgccagtacaggcacttttctcatgaatacagccggtcagatcatcggctgggtgactgatgatcataagaatgacggaagcaaggatatgacggcagccatggccatatccgactataagagcattctgggaaagatgagcaatggcggggcattcccgtactttgggatcaagggacaggaagtgagcgctgtcatgaacagcactgggctgcctctcggagtgtatgtagttgacgtaaatgcagacagccctgcctacaatgccgggatccagtgcggcgatattataaggaccatgggagatgaaaccattgttaccatgaaggacttccaggcagtccttgaaaataccaaccctggagatgtgattcctgtgagtgtttcccgcaatggaagggaagaatataaagagatacagtatcaggtaaccattggagccaggtgatcttcctggcttccttgttgcctgaggttgggttgaaagaaaacggtcttttaaccttgagtttataaagcaaggggatatgcctgcatatccagccgctttgttagtgttcagaatgtggaggaaaaggatgaggtatgtagaatcattccgtgaaggaatgcatgtttcagatgtgtatttatgcaaaaataagcagattgcccttacaaagtcaggaaaagaatatgggagcctgattcttcaggacaagaccggaacagtggatgccaaaatttgggatcttggttctccgggaatcggtaattttgaaactctggattatgtatacatagatgcagatgtgaccgttttccagaattccaaccagctgaatatcaaacgggtacgtaaggcagaagatggggaattcgtccccggagattacctccctgtttccgccaaggatatcgggcttatgtatgaggagtttttaggctttatcagaacggtcaagagtcctcatttaaaaaagcttttggaaagcttttttgtggaggatgccgcgtttgccaaggcatttcagttccattctgcggcaaaaagcgttcatcacggctttgtaggcgggcttttggagcataccttaagcgtggtgaagctgtgtgactattatgccggctattaccctcttattaaccgggatttactcatagctgctgctatgttccatgatatcggaaagaccagggaactttccacgtttccggaaaatgattataccgacgacggccagcttttaggccacatcatcattggaacggaaatggtaggagagaggatccgggcgatccccggttttccggaaaagacggcctctgagctgaagcactgcattctggcccatcatggggagctggaatacggctctcccaagaaacctgctttgatcgaagccctggccttaaatttcgcagataatacggatgccaagatggagaccatgatcgaggtgttaaagggagcgggagacaacaacggctggctgggatataaccggctgatggagagcaatatacggaagacaacggaataatatttaaatgagattaatacagcatacaaatggcagtgataaggcgcatcaggattacgggaatcctgatgcgctttttgggtttgtaaaaaggcgttataaaaaggatacgtaaattttagaatttctttcgttttctctggccctccatttaagattgctttcgtatcctttaaatgaagtaaaaagaaagaaaatgtggtatcataaatgggatgttatagtcagtaactatataatttgtcagacagcaccctatgggtatacctttaggcccggcagcgcggagcggactttgccaggtaaagcagagcgggctctgacaaaaacgggcaggaatgggagaaggagagatagcatggaagcaaaccacatcttattggtagaggatgataaagagatcaggcaggggatcgaaatatatttaagaagtcaggggtacgaagtgtttcaggcggcagatggcgtggaaggccttaaggttttagagagggaagagatccatctggccattgtagatgtaatgatgccccggatggatggcattaccatgaccgtgaaattaagagaaaaccatgattttcctgtgatcattctgtcggcaaagtctgaggaagtggataagatcatggggcttaatatcggtgcggacgattatgtagcaaagccctttacacctatggaactgctggcaagagtaaattcccagctcaggcgttataaaaaatatatggatgtgctggaagaaaaggagcagaaagagaaaagcaatgtttattccatcggagggctggagcttaatgaggatacggtggaggttaccgtggatgaaaagccggtgaagctgacccccattgagtttaaaatacttgcccttctcatgaaaaatccgggaagagtgttctctgcggaagagatttatgagcgggtctggaatgaacgtgccattaacacggatacgatcatggttcatgtaaggaagatccgggaaaagatcgagatcaacccaaaagaacccaaatatttaaaggtggtgtggggagttggatataaaattgagaaacaagcataggctcagcgttgtcctggcggtgatcgtggttttactggcatctgctgtcatggtaggactttatccgttttttaaaaatgagtcggccagatacgaggagcctgtttatgggcaggatgaatttcttcggcatctggtgaccagcaattacgtgctttctctggagcaggcccagtatgagcaaggcagtgtcatttctcctttccagttttatttccctcaggctgaggaggaattaaagaaccccatggctgcgccggcaggggagggagagacggagacagcggtaagtgagaatatcaccgcagaggttgcggaagaatcttacgatttgaccggcgggcaggagcggtatgagtatttaaaagagctgcgaaggaactgcatcagggaatatgaatcctggagccggtattttggaggtatgaaaagtttcctggattatcaggtccttgataaggacggaagagttttgaacgatcatgcaggaggccggtccattgcagggagcaatgaatatacctttaaggcggtgctccattatgatgatctggggcgcatgaaggtggaagctgtaagcggagaaaatgctgtcaggcttttaaatacgctggagaccctgggtggaaaagatcctatgagtgactgctattgggatcagtatctctatgaaacggatctaaagctgaaaagcccgagaaatgtcacctttgcgtatggaatgaggcctcagcagatcgcctcatatgaagaggagagagaaacggtctggaactcttataattactccggcagcgtttccagaatatttatcggcctgatctgtgctgtggctatcgccgcctttatcttcgcctgttttgacccgactcttccggaggccagcagacttttaagagcacctttggagatcattgcaggagtgggctgcggggccgtactttttggaatggggcttacaaatcttgtggcagtgacaaacagggggatttgtatgacgcccttatgcgggccaacttcctgcctcttgttgccagggtcatggtaaggttctggaacctgatgtggtggtccattccatttgccatcgtctattgggcggttttatgcatgcgtgatgtgatacgcatcggctttaagcgttactttcatgaacggactttgtgcggctggttctgggaatgggtgaaaaacctttgccataaggtttatacatttgtagggaatatcaacttgcaggaacggtcggaccggactattttccggatcgttggagtgaattttattatcctggccattctttgcagtttgtggttttttgggatcggtgccctgatcctttattccatagccctgtttatagtgatgagaaaatattacagggaattaactgaaaagtacagcattcttttaagggccacaaaccagatcgcagagggaaatttagaggttgacattgaagaggatttaagcgtgtttgagccgtttaagaaggagatacaaaagatacaaagggggtttaaggtggcggtaggtgaggaagtgaaaagccagaagctgaagacggacttaatcagcaatatgtcccatgatctgaaaacgcctttaacagcgattataacttatgtaaacttattaagagatgaccatgttacgccggagcagagaaaggcttatattgatatactggaacaaaagtccatgcgattgaaatcgctgattgaggacttgtttgaaatcagcaaagccaacagcaacaatgttaccctgaatctggaggatgtggatattgtcagcctgttaaaggaggtcagcctggagctgagcgataaaatagaggagtccaccattgatttccggtggaatctgcccgatgaaaagatcgttcttcctttagacagtcagaaaacctaccgcatatttgataatttattgacaaatatcattaagtacgccatgccttatacaagagcttacattgacatgaagaaggaaggaggctatgtggtcactaccttgaagaatgtttcggctgctgaacttacctttaacccggatgaaataacggaaagatttgtcaggggagaccagtccagaaatacggaagggtccggccttgggatggccattgcaaaaagctttgtggagctgcagaatggacgtctgcaaatagaggtggaggcggatttgttccgggtgatcatccggtggccgattcctgaggattgatgtttatggatataaaagaatggaaaccggtttgaaactccttgaaaacggggagggaagtgtttatactatagataagcatcagcccatgggcaaacgggtgttgggaatgggattaagtccctgggaaatactcttatgtcctgttgagaggggcggagcctgcaaggtgaaataagctggttctgcttggaacgcatgggcgggaaatcaggaaagtgagggctacggttatgataatacagagcagacgggtctggattgcagggcagtttatcccggcacagctggaagtggaagatggaaagatcaaggtagtgcgtgcctatgatgagatggcggcagacaaggattatggcgatgacaggatcgttcctgggtttattgatattcatacccatggggcgtatggatatgataccaatgacggggaaccggaaggacttcggaattggatgagacggataccggaagagggagtgacttctattcttcctactacagtgactcagatgccggaagtgctgaccaaggcggttgccaatgtggcggctgtggcggaaggcggatacgaaggggctgagatcctgggaatccattttgaagggccttatctggatatgaggtataagggagcccagccgccggaggcaatcgctactgcctctgttgagcagtttaaagagtatcaggaagcggctaagggaatgattaaatatatcacacttgcgccggagcatgatgagggcttcactctgacaaggtattgtaaggataccggagtggtggtcagcatgggccactcgtctgctacctatgagcaggcgcttatggggattgccaatggagcgacttccatgactcatgtatataatggtatgacggcttatcatcacagggatccgggtttggtaggcgctgcgtttagggtgagggatatttatggcgagatcatttgtgatgggtgccattctcatttggcggcgcttaataattattatgcgattaagggaagggatcatgcgattatgattacggattctctttgtccaaagcattgccctgttggtatggattttcagctgggcgggcatagcattgagattagggagaatggcctggcttatttaaaggggacgaatacgatttccggaagcacgctgagagcgaataaggggttgaagattttggttgaggatgctatggtgccttttgattcggctttgaattcctgtactattaatccggccaggtgtcttggtgtggatgacaggaaggggagactggttgccgggtgtgatgcggatatggttgttcttcgggatgactatgaagtggttcagacttattgtagaggtagggcgatgttgtagtaagagggaaaaaggattggtttaagggtaagttcattattcggcactctgccttcatccatcatcacctcttaatcgttgttattgcaagaaagggcatccggtacaactggcggatgcccttccttgctgcatactctaaattgcttataatgatttttaatattatcacctggtcctttaaaatgttttcttcacatctcctcaggaaatgcctcctgcaaaggcagcagcactgtaacggtggtatcgccgactttgctttcaatgcacagaccgtactccataccatagcataaccgcagtttattatggacgttgatgatcccgatatgggcatcttcgtccatttctgtttccatttggataggggattccatctgctgacgcagagactccagcaaattgggctggatgcccacaccatcatcgtggatcttcaggtaaagctgatcgtattcgatctgcgcggtgatagtgatcgtaccttcataaccgttgggagcaagaccgtgaaagacagcattttccacgagcggctgcagggtcagcttggcgatgcggtgaacaccaaaagacggatcaacatcgatcatatactgcactctgtcctggaaccggacccgcagcatattgagatataggtctgtgatgaacagttcccgttccagcggcacctgggtctctcctttaatggagtaccggaagatggtggccatactggtacagatatcagcgatgtcccgcatgtctctggttaatgcaattccacgcatacattgcagcatattgtagaggaaatgtggattgatctgactctggtaagcatacagctgtgttttctttttcagcagatctgcctgatacagccgttccagattttctgtcatacgctgattcaggccatgtaccatatccagcatttgattgatgtaggtggcgatggagccgatctcgttttcagggatatttttcagacgggctgtggtatcctgctggttcaacaggcagatctcccgattcatttgcatgatggatttcagaaaaagccgatggacgatccaggccagataaataaataacaggaccatgatgatgatggaaatcacgatgtgtttcaggaaaaaactggactcatcatctgtgccgatcccggaggcggtacagcgcagttccaacccggtgccgggaattctttgcgtatagacgcggccctttggatatgaatggctgtttttcagtaaaatctgtccggtgtctgcagaaacaagctcagcttgcatatcgtctgtactctggaggatggtttgcagttgtttggtgctgcacaaaatggagataacgcctacctgttttccatagtgagcggccatgttggtggcaaagacaggggctgaatacagcaagtaggaagttttatttgtatcctgctcaaagattgtaaatgttgcgggctgatgactggtgtaatgctgcccggcatattctttgacatattgttccactacctgggacaggtaacctttcagactgtaggtggttccattcatatctgtcaacaggacatccattgcatcgggattgtatctttgtgccatcatgatgatagtgttgatacgcacaggattgatggccagttcccctgctgccatcgactggacctcatgactgtaggtgaatgtctgggcggcgttcaccagattgccaagcatcagtgagatgttctgtgtcatagtgatggaggtattttcaccataggtatccaacttttgctggttgtggctgttgagccagtccaacacgaacaattgatagatcatgatgatcatcaccggaatcaggatggcgatgacgaacatactggaaagccgttttctcatattgatcactcccggggcagtgtctgcgactgcagctgttgacggtactctcgcggcgatagtccgcaatgctttttgaagactttggaaaaatagaaggcatcggaaaaacctacctgtcgggcgacatcctccaccttgacgccgggttgtgccaaagcagaccgggcacggtcgatacgcagatcagtcagatactgggaaaacgtggttcccactgattgagaaaacagactgcagcaatagttggggttcagcgagaagcgtttagccagtccctccagggtcattttttcgttgtaatgaacgcgcatataggccaacagttcctcaaaagcggtaggcggggcagccatctcgagcggcagcttaccggcgtggccgtatgtggcatccagtttctttttcaaatcaatcaggagacttttgacttccaatgtgtctgtgggcttcaggcaatagccgaatacgccctggcggatcgcccgcttggcgtatgcaaagtcattgtatccactcatgataattacttcacaagctagtcctttctggcgcaggtactcgatcagttccagaccgcccagatttggcatacagatatccgtcactaccagatgcggaggtgattccataagcgcctgcatcgcctttctggaatctaagtatgtaccggtaacatgaaatcccaattcctcaaacggaaatgttttttgtatatcgacgatggaccaaggttcgtcatcgataatcacagcatcgtagaccattctttgccctccttaaccattcttcatccgttcaaaacatggaaaattctcagataatcgatatattttggtcatttttccttaatacagtacatgtacgaaaatttatttgtgcattataattaaaacataatcattatagcaaataagcagaagcattacaagcaactttgcagatggtaacttgtgccagtttttgtttgaaggtgtggacagtggctggcggtgtgaagcgatttaaaaaaaaggaggagaagattatgaagagagtaatgtctattctgttagcggcagctttggcagccggtttgactgcatgcggctcaagtgcatcagacggcacagccacgacagcggctccgggcggatcaacggaggctcagacaacaggaggtgcaggcggagagaaagtcacactaactttttccacctctgtttatgtggaagagccgcaccgggcggcgattgacaaattgatcagcagatatactgagctgaatcccaatgtcacagtcgagatctttggtgccggatgggcggactactggaataacttgacaacagaggtgttggctggaaatgaagcagacatcattcaggtatatccggaaaatattgcaagctacaacagccttcttgcggacggtgtctgcgtggatctggcgccttacataagcgcgtcaggtattacagcagatcagctgtccgggcaggaattctgcacaatcgatggtaaaacactggcacttgccaactatgcctggggaacaaccggtatcttctaccgcaagagcatgctggaagagaaagggatcgatcctgagagcatcaaaacccaggaagatttcctggaagcctgcaaagtgtttgcagaagatggaaaatatggaatgggtgtggtggtcagttcccacagttttgtggtcggtgaatggtgccgcatgctggcacgtccggtatcaggcggactttatttcctggatggtgaggctggccccttcacagcagaacgtgtcaatgtcaattcaccggaaaatgtatgggcagcccagtggtggcagcattttctgatggatgaaaagggaggaaaacctgttcctgataaaaaggattcccgtgaattgttctggaataaggaagtgccgttcaactatgacggaccgtggttcgtcggtatgaccgcgagcgtgatgacgcactgatggatgacatcggactgatcccttcttttgatgtggtctatgaaggaaaaacctataaacccaatccaaccaactatccgctggttacaatgctgagtaaaaactgtaataacccggaagaggcttggaaattcatggaatggatggcaagtgatgaggcacaggcactggttgctgattgtggcatgatccccagcaacaaagcttatgcgtctacaccggaatatatcgccggtcatgagctggaacagaaattccttacgtttgcccaggagaactacgcggatctggtcagtgatccggcgataccgcaacagcaggaactgagccaggtgatgatcgatgctacacaggcgatgttctcagaacaacgggctgatgcaaaaacaacattggatgatgcagccaaacagatcaaggagattatgaataaataatcagacaataaaaatacgaatcagccgcaaactgatgacggctgattcgttgaaagagaaagcattttgtccgtatggaagtggaatgacagtagaatggaggtatctatgaaacaaagcggagcacaaaagaaagaccaagcgggggaacgatggggagctgccttgtttctggcgccactgatcatcatcctggctgtgtttctcgcactaccgatcgtgagggctgcagttatgagcgtgcagtattggtatatgagcaaaccttcacccgatggcaattactttgtcggacttaaaaattatcaggcagtgtttcaagacagccattttttcaattcagtgaaggtgacactcctttatatcgtggtaacggtttttgtacggtatctgttgggattcggggtggctttgcttgtgaacgagcggtttcggggcagggcggcggctcgatctatcctcatcattccgtgggcgattccggaagtggttgcctgtctgatctgggtgttgatgtatgacaaggattatgggattgtcaattatctgttttccaatctggggcttatccaggaaaatgtgggctggctgcaaaatcccacggccgcgttgccggcggctatggctgtgaatatatggaaggggtttccatttgtggcgatcatgcttttggccggactccagagtataccaggggaacagtatgagtcggctgcaatcgacggtgccaatggctggcagaaactgatggctattacgattccggggattaagccggttgccaaagttgtgtttcttctgctgattatttggtcgatcaaagactatgccatcgcctactgtctggcaaagggcgggccgtccagggcgacagagcttcttacaatctttatacagcagacggctttccagtattttgacttcgggaaagcggctgcggcagggatgatcatgttggtattttccattctgtttacagtgttttatttccgggttgtggacaggaaggaggaagcggtatgaaaaaaccattgctctacagaatcatggtgatcgtcctggttattcttatgcttgtatttgtactttttccggtattctggatgctttcgacttcatttaaggcagctggagaagtctactccaatccgccgggatatataccaaaggagcccaatctccggggctatgtgaagctgcttactgaaaaatccaacagtttcaattttctgatatgggcaaagaatagtttcattgtggcattgtgcaccacgttgttttctatggcgatcgccgccttgggcgggttcggactttcccggtttcgttttcggggacggaaggggatcatgtacacaatcctgatgacacaggtactgccggggagtttgctcattgtcccgttatatacaatcatgtccagcctcaagctgttagataccacgctgggactggtggtggcaaatgtaacatttgcggttccattttgcacatggacaatgaaaggtttttttgacagcatccctgcatccctggatgaggcggccagggtggatggtgccgggcgctgggtgacctttatgcatatcgttcttccgttgacggtgcccggactggtggctacgtgtattttctcttttattacaggctggaatgagtatttatttgccagtatttttatgcgtacatacagtaagtggacactgccggttggcatttccagttttcaggggcagtatggcactgactggccgacgattatggcgggtgctttcatgattacaataccagtggtgtttgtattcctggtgctacagaaataccttgtttcaggtatgactgcgggagcggtcaagcagtagggctatgaaatggatgcggggaagaaaatatttaactgaatcaagcagcgaagaggattgggaatatccgcttgactaaaatgaaaggtaggaatcagaatggaaaaggtaaaaatgggaattatcggcgccggtgtatgggggaaacacatgcttcgatctatcgtgaacaccccaatgctgaaccggttgccgtctgcgataaagacgaagccagagcaaaagcactggctgcaaagctggggattacacaggtttatacagattatcatgaaatggcagcaaagagcgattgtgacgcggtagcagtggttacgccggattttcttcatgcggatatcgcagtttgcatggcagatgccggaaaacatatgttgattgagaagccgctggcaaccacaagagaagatatagcgcgtatatgcgaagcggtggaaaggaacggtgtgcgctgcatggtcgacctgcataaccgatggagtgcggcgtttaatgtggcgaagcagaagatcgacgacggaacaatcggtgaaccctggacagcctatattcgtcacagcgacatcaaatgggtggccacagacatgctcaaatgggcagcggattcctcgattctctggttcctgggcagtcacagcctggacgcattgcgttggttttttaatgacgaagtgaaacaggtatattctgtgaaacgagtggggatcttgaaggaactgggggtggatacggcggatgtgtatctgacgactgtgatctttcagaatggcgggatcgcccatatggaaaatggctgggtaacaccgaatggcaatggaaatgttaatgattttaagtgtagtgtgatggggacgaaaggacaggtaaatattaatgcctccaatcacaacctgattcaaatcgctacggatgaatgcatgcagatccctgatgttatggtaactaatatggtatttgacaagtgtaagggactttcttatgagagtatacgcgactttgtggatcggctggtggatgggaaggagtttcgtgtaacgctggaggatgcgcgtcgcattgcactggcaattattgctattcatgagtcggcggatacggggggattgtggatgtcgtgtattaaggaaataattgggcttgattgtgtggaacgctggtccgcagtgctcaagctcgaatccgctgcgctacttctcgcttgacgggctgtcgccctatgtccataaaatcaaaagagctcataagaatgctggcattcttatgagctcttccgcttttgtggacgcactgcttgtagctttacaatatccgtacattcttcaatgctccggtttttgaaaactcggtccattcgcatacgtttacagcatgatccccaatgcgttctaaatattttgctaccatcagcaaatcaatgcactggtcaatatgctcgttagagtgttttagtaaatctactacatcattttttaccttatcaaataattcgtcaaccacatcgtcctgcttctcgattttctttgcggtttctaaatcctgattgatgaaggcctcaatggagctgcggaccatttctcttgctgcggcggccatagatgggatgtggcggacgacgtggtatacgtgttcgcctttgatgcgcaggatgagttcggcaatgtcggaagcgtggtcgccgattcgctctaagtctgtaaccacttttaaggcgctggaaacgactcttaaatctccggcaacaggctgctggcgcaggatgatggagaggcagcgggcttcgatggaacgttctaagtcgttgatggtacggtctccttttatgatatcctctgccttttcaaagtcctgatcttcgaatgccacaaaacactgttcaatggaggtttcaaccatacgccccatttcctttatgtcgtggtttaagaggtctaattcgtgttcgtaattaactcgcgttgtcattttttgttctccttctttgttctatcattcaagtacgccagaggcgtacttgctgcgagtggtacgtcagccttgctgacatcatacatctgtgccgctctgcaattcgccaaaggctttatcttctttcaagataaagcggatcagccgaagcggcctgtgatatagtcttcggttcttttgtctttgggagatgtgaacagctcagttgtggaagcgtattccactacttctcccacaaggaaaaaggcggtataatcggcgattcgggttgcctgctgcatgttatgggtgacgatggcaaccgtgtatttctctttcagctcatccatcaggtcttcgatttttagggtggagatcgggtctaaggctgaggtgggttcatccataagcagtatctccggctcaacagccagggcgcgggcaatacaaaggcgctgctgctggccgccggaaaggccaagagcagacttttttaggcggccggatacctcatcccagagagcggctcctttcaggcttttttccacaatggagtccagttcggatttattcttgattccatggattcttgggccataagccacattgtcataaatgctcattggaaatgggtttggctgttggaataccatgccgattttttttcgcagaagagtggtgtctaccctgggatcgtaaatattctccccgtctaaaagaacttctccttctatttttacgcttggaaccaggtcattcattcgatttaatgtttttaagtaagtggattttccacatccggaaggcccgataaaggccgtaattttatttgtataaagatccaggtttacatcctttaaggcatggttggtcccataatatagatttaaattgctggttgagattttaactgtattggtattcacgattctttaacctccgtattgaatttatgagacagaaattttgcaagtccgtttattgccagtacaatgaccagaaggacaacggcaattccgaaggcctgatcgtatttagccttttgcatgcataggtaaagctgaatcgtcagggtgccgcctgattcaaatatttttccgaaaaagtccctgggaagaagataaccgcttcctgccgtaaagagaagggcagcggattctcccacgatacggccgatggccaggatgattccggtcacaatgccgggcatggcgcttggaagcaggatggtccggatcatataccatttggttgcaccaatgcccaaagcgccggagcggtagctttccggtacagtctttaaggcttcctgtgtggtcctggtgatgagaggaaggaccatgatggacaaggtcaatgcaccggtgagaatggaataaccaaggcccagggtgatcccgaaaaatacatagccaaataagccgaagatgatggaagggatacctgataaggtctctgtggtgaactcgatgatgcggaccacttttccgccttttgcatattcatttagataaatggctgcaccaactcctaaaggagtggcgatcaataaggtaatggccacaacatataaagtgtttacaatatttcccaggatgccaaaggttcccctgatggtacttggcacgctggttaagaattctacgttgatctgggaaatgccccggacaaagacatagcccatgataccgattaaaaccagaatggagatggaagcgcataagtaaatgagaaccgttaagacagaatcagagatccggtttttccggttataaatgctgtgtgctgcagcagaatttttttgaacagggatgataatatcatttgtcatgacgttcctctcctttctttaacagattattaagggtaatgttaatgagcatgataaatgcaaacaggacaaggccaatggtaaaaagcacctgtttgtgaagcccggcggaataagacatttccgaaacaatggccgttgtcaggaagcggactgagttaaaaggaagcggaagatttactgcgcttcccgacaccaggctgatggccattgcctcgccaattgcccgccctgttccaaggacgattgcggtgatgataccggattttgccgccggcagaaccgcattgaaaatggtctggatcttggtggcaccaagggccagggaagcgcttcttaagtgctgcggcacagcccgtagggccgtttcgctgatattgataacagtgggaagaatcattaaggacagcactaaaacagcagaaattaaattggcacctcccgtaaactgatgggtggaagagcctgcaaatatttttaattccagcttatacatgataggatttaaaatcaggataccaagcaaaccataaataacagaagggatgccggctaacagctccactgccggacgcacgatattggtaagcctttcaggggccacttccgccaggaaaacagcagtcatgacgccaatgggaacgccgattaaaatcgccatggctgttcccatgatggaggtcaggataacataaaggatgccaaagcttggagaagcggcttccggcttccagatggttccgaacagtatatccaggatacccaccttaaataaagccggagtgccgcttatgatcatgtacagagtgatggaggccactgccagaacagcaaagaagccgcagacagtaaagataacctctgcagcatgttctacccctgatttacttccgtggccgctaaatatggaataagactttggacgcatataacagctcctttcaaaaacggggacgtagcatgattctctggccgcgtcccctgtaaatattatcgctatgcagtatgagaagagttccttttcaactagtttgccgggattaaaccaacagattttactaactcggttccgtcaccggaatagatatagtcaaacaatgctttcaccagatcgctctgctcggaaatctctcccttggttgccataacaaatggacggcttaagaaataggaaccggctttgatgttttccggagtaggctctatgccctccagctttaaggtactaacggtgtcatcaagaacgtccagagaaacataaccgatggagcctggagtggaagcgacctttgccataacggcaccggtgctgtccagttcgttgctgtatttgcaggcatcttccagctttaacagctcttcaaaagcgcttcttgtaccggaaccggactcacgtccaatgacaacgatgggctgatctgctccgcctaagtctttccagttggtggttgtaccattgtaaacgttgatcagctgatctttggttaaatcttcaacagtattggcaggatcagagacaactgcaatgccgtcaattgcaacgatgttttcagtaacaccttttgctatttcttcctcttttaagttacgggaagaattgccgatatcagcggagccattggtcactgcttcgattcctgcgccggatccaacgaattcggcctgtacggtaacattcggatatttttccataaaaacttcacttaaagcggttgcgaacttctccatagaagtagaaccaaccatgctgatagatccttttaagtcggcagaggcctcttctttggcagccgtggttcctgcagaggtggtctcagtggaagcgccagccgcagttgtagtactaggagcctgtgtctctgcattattgctgctgccgcagccagctaaagttcccatagtaagaactgccaatccagctaatgcaagtgctttaacaatattttttttcataaattactttctcctcttttctttttaaattgctttcgcttacatcatggagtatatcagcctaaaaacttttctgatatcatgttttagtatagaaaatgtaaaggttgtgtaaagcatgcccgcactcattttttcctctattagtattcgctgaatgggagaatgaaattcttttatttccttcagaaggcggtgagaaaggaaaaaagactggaataattacaaaaaacagacttttctgtggaaaaattaacggaatggactggacagaacagtaagaaatatggtaaattgtaacgtgcgcttattttatagtagaaatataaaaaatcattccgtaaattaagaacggatacaaaggatacaagacaggagggcgttttcatgggagcatatcaactgaaaatcacgatcaaaggcagcaagccgccgatttggagaagggttctggtaccggaaggaataacctttggaaagcttcaccaaacgattcagacagcattttgctggtccgacgaaaacctgtatgaatttgaattccgttctgaaggggtaagggtagttccggataaggagaacttgtcccagaaatttcaatatcttttaagtgatgaaaagatcgacagcctggtatcaggtaccggcaagtttacatatatatatggccctgataagaactgggagcttgccattcagatggaagataaggtcgaggattatcagggaaactggggacaggttgttaaattcaaaggagatacagttccggaatcctgcaaaagcatggccgggtattatgaacttttggagtcaggctccaaggaactgaaagaatatgatatgtccgaggtcaataaacgcctgggtcaggaagtaaaatctgcttcggaaggggtccttatcgccgatgttttcgactgttatgataaaaacagcatccttgagattgcaaaaaggcacagcatgggcggactttctaaattaaaaaaggaagaactggcagaacggaccatcacccatatcctggatcataatgtcatgggtcgttattttctatgtgcccgcaattcagaaataaaattatttgagcaagtggcggaaggtgattttcaggtaccgtcttttgaagcggaagaaatggattttctttatgcaggcggttatgttaccgcagggcctgacagtcaatttatggttgcaaaagaggtaataaaggcatataaagaggtgaatactccgggatttaaggaagatcgtgagcgcctcagtaagatcggagactatctccgggcggcaaacgccctgtatgctgttacgccgacgtcggttcttttggaaacatttaataaatatgaagataaaaagcttacggtggaggaactgctccatgcctatgagcttcttcatccataccgtcctgtggtcatttatgttgatggaagctttgtggatggaacgctggcagggcagaatggcatggaaggcttacagcggatgcagaaaaaagttccttattatatccctgcccagcaggaaatccgtttcatggcagacaatgggggctttttaatgactcaggaattaagccggctgagcaaattcctgacagatgaaatgaacgttccggatgaggtaattccatatatgctgcgacaggtgcaggcgaaactcagtatgggcggacagcttcaggaggtcgtggatggcatagaggcctccgggattatgtttgaatccgcagagcaaatagaacagcttacaggtattatcacagatgtatggaatcataccaggatggtgttaaacagaggccataagccatatgaaatggtgatgaagggcttggaggctgtatctgttcagcgcaagagccctccgaaaatttatccaaacgatccttgttcttgcgggagcgggaaaaaatataagaaatgttgtggtaaaagaaactaggtatagtaagaaatgctgtggtaaaaaaaattagatatgttaatctgggttctgtctttttctaaggacagaacccgttttaattatcttgaatattttgaaaatctagtttttctagaaaaataaaataattcaaaaaaattgttgacttttgtcgatgcctttggtaagatataactcgccgctgaaaacggcggcaaattttcttctaaaaacacatcgatgatcgatgaaaaagcttttaagaaaatgaaaaaaatggttgacaaaaacagacagccatgatatcctataaaagttgctgctgcgacagtaacaaacaaaatgcactttgaaaacagaagattgaacagtatgtaaaaccctgaaaattctaataaaacaagccattgtttgatggctttgaatgagaaaattcagaacgaatacaagcaattgtatacgaaccaaacaacaagtaaaacgggaaaaaaattagctagttagttgattttgaccccggattgaaccgaatggcaggtccaggcggtatgctcatgaagctttgcttcattcgctaccatttgcttcgcaaatgttcgttgatttccccaaatcccttatggaagtaaacttccaacgggcttttgtgcaaatcaccgaccgctttcaaagactatctgcttaaatttgagagttcgatcctggctcaggatgaacgctggcggcgtgcttaacacatgcaagtcgagcgaagcgatttaaatgaagttttcggatggaatttaaattgactgagcggcggacgggtgagtaacgcgtgggtaacctgcctcatacagggggataacagttggaaacgactgctaataccgcataagcacacagtgccgcatggtacggtgtgaaaaactccggtggtatgagatggacccgcgtctgattaggtagttggtgaggtaacggctcaccaagccgacgatcagtagccgacctgagagggtgaccggccacattgggactgagacacggcccaaactcctacgggaggcagcagtggggaatattggacaatgggggaaaccctgatccagcgacgccgcgtgagtgaagaagtgtttcggcatgtaaagctctatcagcagggaagaaaatgacggtacctgactaagaagccccggctaactacgtgccagcagccgcggtaatacgtagggggcaagcgttatccggatttactgggtgtaaagggagcgtagacggcgatgcaagtctggagtgaaagcccggggctcaaccccgggactgctttggaaactgtgttgctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgttggggagcaaagctcttcggtgccgccgctaacgcaataagtattccacctggggagtacgttcgcaagaatgaaactcaaaggaattgacggggacccgcacaagcggtggagcatgtggtttaattcgaagcaacgcgaagaaccttaccaagtcttgacatcggaatgaccggtccgtaacggggccttcccttcggggcattccagacaggtggtgcatggttgtcgtcagctcgtgtcgtgagatgttgggttaagtcccgcaacgagcgcaacccttatccttagtagccagcaagtcaagttgggcactctggggagactgccagggataacctggaggaaggtggggatgacgtcaaatcatcatgccccttatgatttgggctacacacgtgctacaatggcgtaaacaaagggaagcaaaggagtgatctggagcaaaccccaaaaataacgtctcagttcggattgtagtctgcaactcgactacatgaagctggaatcgctagtaatcgcggatcagaatgccgcggtgaatacgttcccgggtcttgtacacaccgcccgtcacaccatgggagttggtaacgcccgaagtcagtgacccaaccgcaaggagggagctgccgaaggcgggactgataactggggtgaagtcgtaacaaggtagccgtatcggaaggtgcggctggatcacctcctttctaaggaagaagaagtaagggttttatatactgttgagtctttggttttcaaaagaagtaaaaaagaataataaggaaacactaagaaagacgtaaaatttctggtgccgatgcgcttaggggagacacccgttcccatcccgaacacgatggttaagacttaagcggccgatggtactatgctggagacggcatgggagagcaggtgggtgccagattcctttaaaaaaatcacttgaaagagtgttttatatagaacggacacgttccaatgggcggagggaaaagcgaagcctgtgttaaagaatgtgttaacctgattcagcagggcagtgctgttttatatagctggtttttaccagtgatccgtgagtttgagttgatcaagctttcgaatgactgataaacttcagtcacagtgatgcagttacgaaggtgcacttcgaaaagctgacgcttttctcagtcacggcgttccacgcctatacaatcacataaaaaactgcttatgaacacaagtgttcaacacagttttccatatgattgtgcacgcttctgattgcatcgcgcatgtaccttgaaaaccacatattgaaatatatctagattagtttttatatgtcaaagtataaaaacaaaatcaagacatccgaggtgttacatcttatgatgtaaccaaacaaaactcgttaaagtaaccgtgtaacgtacggtgaaataacaaacctaagaccagagatacaacgctatgtatcttagatgagtcacccgcacccgcaggtgaacatcgaattggttaagctaataagagcgcagggtggatgccttggcactaagagccgatgaaagacgtgataagctgcgaaaagcttcggggaggagcaaatatcctttgatccggagatatctgaatggggaaacccagctgagcaaacctcagttgtcgtatggtgaatccatagccatacgtcgggaacccggggaactgaaacatctaagtacccggaggaaaagaaagaaaactcgatttccaaagtagcggcgagcgaaatggaaagagcctaaaccggtatgcgtgcataccggggttaggactgcaataagtgagacgatttgttaccagaacggtcctggaaagaccggccatagaaagtgaaagccttgtatgggaaagcaatagtcagcgagcaggatccaaagtaccacgagacacgagaaaccttgtgggaattcgggggaccacccccaaggctaaatactacttagtgaccgatagcgcatagtactgtgaaggaaaggtgaaaaggaccccgggaggggagtgaaagagaacctgaaaccctgtgtttacaagctgtggaaccacattttaagtggaaccgcgtactttttgtagaacggtccggcgagttaccgttactggcaaggttaagcacttaaggtgcggagccgaagggaaaccaagtcttaatagggcgaatgagtcagtaaaggtagacccgaaaccgggtgatctacccatgtccaggttgaagtttccgtaaaaggaaatggaggaccgaacgcacatccgttgaaaagggtggcgatgaggtgtgggtaggggagaaattccaatcgaacccggagatagctggttctcctcgaaatagctttagggctagcctcgtattagtctgccggaggtagagcactgaatttcctagggggcgtcaaagcttaccaaagaatatcaaactccgaatgccggtcagatgatgtacgggagtcagactgcacgagataagttgggcagtcaaaagggaaagagcccagaccaccagctaaggtcccaaagtgcgtgttaagtggaaaaggatgtgggatttcagagacaactaggatgttggcttagaagcagccacacattcaaagagtgcgtaatagctcactagtcgagaggtcctgcgccgaaaatgtccggggctaaaacacgacaccgaagctgtggaatgtgtattcatacacattggtagaggagcattcttaacgcacagaagcattaccgtaaggagatgtggagtgttaagaagagagaatgccggaatgagtagcgagatggaggtgagaatcctccaggccgaatatctaaggtttccagagtaaagctgatctgctctgggtaagtcggggcctaaggcgaggtcgaaagacgtagtcgatggacaacaggttgaaattcctgtaccgcatatcatcagaactgtggggacacagaaccgaggaagaacccgggaatgaaaagaccggggcaagcattttactggctgagatggaaaatccgctcagcaacaggaaggtgtgacgcgtaccgaacacaagtagggaagtcttcgtaggggctgtcaagaaaagccgctattgtgtgatatgtgcccgtaccgtaaaccgacacaggtggatgaggagagaatcctaaggccggcgggagaagcattgttaaggaactcggcaaaatgaccccgtaacttcgggataaggggtgcctgagaaatcaggccgcagagaataggctcaagcaactgtttagcaaaaacacaggtctatgcaaaaccgaaaggtgaggtatatgggctgacgcctgcccggtgctggaaggttacgaggaggggttagcggcaacgcgaagctctgaatttaagccccagtaaacggcggccgtaactataacggtcctaaggtagcgaaattccttgtcgggtaagttccgacccgcacgaaaggcgtaatgatttgagcgctgtctcgacaatgcacccggtgaaattgaagtaccagtgaagatgctggttacctgcgccaggacggaaagaccccatggagctttactccagcttgatactgggattcggtactgcatgtacaggataggtgggaggcagtgaagataggacgccagtcttatcagagccgatgttgggataccacccttgcggtattgggtttctaacctgcagccatgacctggctgggggacaatgtcaggcggggagtttgactggggcggtcgcctccgaaagggtatcggaggcgctcaaaggttccctcagaatggacggaaaccattcgaagagtgcaaaggcataagggagcttgactgcgacaccgacgggtggagcaggtaggaaactaggacttagtgatccggtggtataaagtgggattgccatcgctcaacggataaaagctaccctggggataacaggcttatcactcccaagagttcacatcgacggagtggtttggcacctcgatgtcggctcatcgcatcctggggctgtagtaggtcccaagggttgggctgttcgcccattaaagcggtacgcgagctgggttcagaacgtcgtgagacagttcggtccctatccggcgtgggcgtaggatatttgagaggagctgtccttagtacgagaggaccgggatggactgacctctggtgtatctgttggtgatcaacaccatggcagagtagccaagtcgggaagggataaacgctgaaggcatctaagcgtgaagccccctcaagatgagatatcccatcgcaagagtaagaccccttgaagacgacgaggtagatagggcagaggtggaagcatggcaacatgtggagctgactgtcactaataggtcgagggcttaaccaggttggtttaggtaagaggaaaaagaacggatgaaaatagatatgtaacaatgtgtggttttgagggtatatgcagcaggttatagtgcatatcacgaaataataatgcgtaaatccaggaatgggtttgcgcttttttaaattttcagcggagcagccgtgtgaaacaaccaagtttcggtacagtagcttgtctggcaaatgttttgttttttgaaaaatatggaagatggtcttgcattggagcgcattccggggtaaattaagatagaactaaactataacttttaagagagcgtttaactatgcttaaggcttttaaagaatggactgaatataatataggcttttcaaagaattaaggagatataggagatgaagagagaacaggatgccacccgaatattaatggtttgtcatggaaacatatgcagatccccatggctgagtttgttatgaaggatatgatagaaaaggagaacttgggcaatcgttttcatgttgcgtcaggggctacaagcacggaggagatcgggaatccggtgcaccgtgggacaaaggaaaagcttaaggaatatggaatttccacagccggaaaatatgcggtccagttatccaggaaggattatgacaaatacgattatctcattggtatggaacagcgtaacgtgacaaatatgctcagaatcctgggaggagatccggaaggaaaagtgaggcggcttttggacttttcctctgatccaagagatattgcagacccatggtacaccggagactttgatcgtacctatgatgatgtttatgaaggctgcaaagctcttcttgcgtttattttgaatgaggaatcaataaagcattacaggtagcagggaggcatttttatgaaaccacttaattttatagtagtaggctccggttggaggtcccttttttatgccaggatcgccaaggcttatccggattgttttaatgtggcagcgtttctttgcaggacaaaggaaaaggcgcggaagatacaggaggaaaccggaattaaggccgtgataagccaggaggaatgcctgtcagaaaatccggatttcattgtagcggctgtaagtaaggattccatttttcaggtgacaagagaatgggcgctgaaaggatatccggtactttgtgagactcctgctgccatggaattagaagatcttcaggaactatggcgccttcgcactaaggagggagccaggatccaggtggcggaacagtattttagatatccggtttttcaaggggctattgagatcgtgaaacggggataccttggagacccgtatatggttaatatctcggcagtccatgactatcatggggccagtctgatcaggcggcttttgggaatcggttttgaaaatatgaagctgtatggaaagaaattccggtatccggtggtggaaacagattccagatacggactgattgaagacggcagggttagtgagagagaacgggtcaggctgacctttgaattccaagggggaaaaacagccttttatgattttaacggcatacaataccattccaggatcaggggacgccatttaaacgttcagggagccaaaggggaattggatgactggacgctgcgttacgtaggagaggacaaccggtccagggagtatcagatcataaaggaaccatttgaaacaggaggtggaattaagaggatatgcatgaagcaggaacagctttatttaaatccgttttatgagttgggaaaagttaatgggcttcctcaggatgaaacggcaatagggacccttatgcttgggatgaggcgttttattgaggaaggcgcagaggtttatcccctcgcagaaggattgcaggatgcctatgtaaggatccttatggaacaggcgctgaaaggcggacagacggtagagtcagaaacacaggtttggggctgatggaaaagaggcttgtttttccgtaagatgcgaaaaatcaagcccattctgctgcctgtgaaaattatgattaatcattatcatcaatgatggtaaggttaaaggattcgcaggataaatccacatccctgcctgccttttgagcaggactgatgaaacggatgatagggcgcagggaaaatcccggcgtattatctttgacgaccgctgagcttccgtcactgagatggacaatggtaccgatgggatatgcggagacacagtgaaggaaagctgtcagcagttccgggtcaaaatgggtgttggagcagctggtgagataatcaaaaatctgcctgggagaccatgctttccggtatggcctggtggaattgagggcgtcatatacatctgcaatggccagaatacgggcataaagggggatatctttgcctgaaaggccgaaaggatatccgcttccgtcatatttctcatgatgggtctgaaccccctgcagcaccgcctgggaaatcaccatatgttcttccagctttttataggaaaggcttgggtgctgcttcatgatttcaaattcttcgctggttaagggtcccggcttgttggtaatatcaatagaaatatccgttttcccaatgtcgtgaagaaggccgcagagtgccagatcatttaaattggaaatggaaagtccgatgtattttcctaataaaacgcttaaaatgcccacataaaggctatgggaataggtataaccgtcataatctctgatatcaatcaactgaaagagatacttatccttattcaggacattcataacaacggattcggctactttggcgatctccacgtaaacctgtttgctggactgaaaggtgaatttttttaagctctggtcaaagacatcacggatgcttgtgagcatttttgcctttaattccggctccacgaagtcttcaggttcaatgccttccgttagcgctgtgctgatataagccccttgtattccgattcttttcatgcggttgatcatacgttcacttagtttgcagccggttaccgcaaaaggaagcattgggtttattcccgggatgtttcgggctaattccataccttcagtcaatttctcaataggaagataaatcaattctttcacctcgacagaccaaaacgcagtctcttctttctgttcctcaaattccttttatgctatccgtaaattcctttttatgttaaagttggaaatatatacacaatgacacattaaattatagtgggaattgactaatgcgtcaatgaaaatttacattttagacactagtatggcagagaaaaattgaggggtattttatgcaaaaatcattttgatttttatttttcatggaaatccggattgatttagaagggcaatgaagtagttttttaaaaagaaggttaaagaggggaaatcttatgattgaaatcttaaacggtatgcatgagaccattcattatgagtgttcattagggcttcgtctgtatcataatacgaaatatgaggattatccggagcactggcatggggggattgagataatcatgccaattaagggagggtatgaggtcatagtaggcgaagaacattatcccattgaagcagaagacatcattctgatccattccggtgtgatccattctttaaaggcacctcctgtgggagaacgttacattctgcagtttgatacggcccttctttaccatttaagggagatggaaaccctgcttcacatgatccctccggtaatactcatgaaaaaagaggacaaggattcccctcatggatctgtaaagaaaaagctagataaaattattgaggaataccagggtaacagcagcttccgggaagcgtccatctatgctgctctcattgaaatttatgtggaattaggtagaaatacagtgtggcgggatgagggcggccggaagctccacaccatgaaaggacacgagtatttcgaagcggtcatgagcgcctgtaattatattaatcagcactttatggagaatttgacattgggagaagtggcacggataggtggattttccaaataccactttacaaggatttttaaacagtatatgaatatgactttttacgagtatttaaactccaggcgtataaaaagagcagaagagcttttgtataatgctggggaaatgagcattacagaaattgctatgagttccggcttttcatccatgagcgcatttagccgtacctttaagatgataaagcactgttctccaagcagctacagaaagatcaggcagtaggcgtacctgcaagaagaataaaggaatgaatcgttcccatgtgaaagtcagccatggaaattatttccatgggaaaaagcaatatgtgcaccattggaagcaagaagtgtgatgcttaaactgccatgttaatgttatgatgaagtcaccaggaaaaaggcaatcagccggaaaataagattaacaggagaggataaatttcatgaatcaggataagcagaaggaataccggaaacgggcaaaaaaactggtggcagaaatgacacttgaggaaaaggtttcacagaccgtgcatagggcggcggcgatcccaaggcttggaataaagggctataactggtggaacgaagggcttcacggtgtggcaagggcaggaatagccacggtgtttcctcaggccattggtatggcggcaagctttgatgaggggctgctttgggaagtggctgatgtggtttccacagaggccagggcaaagtttcatatgcagcagaaatttggagattcggatatttacaaaggccttacgttctgggctcctaatgtaaatattttcagggatccgcgctggggagaggacatgagacttttggagaggatcctcatctgacctcacggctgggagtcagtttcattaaagggatgcagggtgatgatgagaattatatgaaggctgcggcctgcgccaaacattttgcagtccattcaggtccggaggatgaacgccactcctttgacgcggtggtaacaaagcaggatatgtttgaaacgtatttacctgcttttgaggcatgcgtaaaggaaggaaaggtggaagcggtcatgggggcctataacaggaccaatggggaaccctgctgcggaagcaagactttgcttaaggatattttgcggactgcctggggatttgacgggcatgttacctcagactgctgggcggtaaaggattttcatgaacatcatggggtcacaggttctgccctggaatctgccgccctggctatggaaaacggatgtgatctaaattgcggaagcctgtttttataccttaccgaggcggtgaacagggggatggtatctgaggagcggttaaatgaggcagttgaaaatctgatggtgaccaggctgaagcttgggttgtttgaagagccggaacacgtagaatacagtaaaatcacctatgagaataatgataccagagagcataaggcgttgaatttcaaagcttccagaaagtcctttgtgcttcttaaaaatgagggacatgttcttcctctggataagagcaagataaaaaccattggcatcattgggccaaacagcaataaccggaaggcgcttattggaaattatgaaggcactgcatccaggtattatacgatctcagaggggatccaggattacgtgggagaagatgtccgcgttatggtttcagaaggctgccatttatgtaaaccaagggtgagcggccttggacaggagaatgaccgtttgtcagaggttcggggagtctgtgagtccagcgatgtgatcattgcctgtatgggcctggattccagcctggaaggggaagaaggagatgaaggtaatgaatttgccagcggggataaacccaatctctcccttccgggactgcagcagcaggtattggaggagatctataagagcgggaagccggtcgttctggtgctgctatcgggaagcgccctggcggtatcctgggcagatgaacacattcctgccattattgagggctggtatccgggggcccagggaggccgcgccctggctgccgtgctgtttggagattattcgccggaaggaaagcttcccgtcaccttttacaggaccacagaggagcttccggcctttacggattatgccatgaagggcagaacctaccgctacatggagcaggaggccctttatccctttggttatgggctttcttacacagatttttccgtaaaggatgtggctttaagcaaagaacggatccaggagggcgatactcttaccataaaagcggtgttaaagaatgagggccttatgaagggggcggaaaccctgcagatatatgttaagtcctgtgccccccaaacgccgaatgcccagctgaaggcattcttaaaagcagagctggagcctggggaggaaagagaagtgcaggtgacgctttctgacaaagcatttgctttacgagataaacagggagatctggtaatggagaccggcacatatcaggtgtatgttggaacacagcagcctgataggcggagccgggagcttacaggaaaagagccggaaatggtgacggtatccgttggtcagcggggtgttttggaaacttgctgcatttagtacctggggttgttacaaaatgaattattataaaaaaattgcataaaataaggtgctgcgctgtctgaggaagaagaaccctgagacagcgttttttggttacaaagacaatggttaaatgaaataaagtaagtaatctaaaattttaggaaacaaaatgaaaaattttggaagaaaatataagaattttgtaagagttttatcagattctacttgtctttaatataaaattttattataatattacagtatgtgaaagaccggatatacagcgttattatataaaaactgatacaaaggaggccgtatgatcaaaagacaagagagcaatttcaaaaaagctgtcaatgaattgctgggttattcctcggaggctgaggatgagatcgaaattccggagggcaaagaggagcccaaggctgtgatgaacgagagaccggatgtggaagcggttgtaaaccagacgcaaaatcctgttcaaaactcattttataactccgtccaaaaccccaatcccatgcgcatgacagctgagaccagtaaggtgtcctcctacacggtggagacgaaatcattatcagtggaggccatgaaccaggtgtcttccaaggtggcggtaattacggaggatatgattgtaaacggagatattgccacccagtctgatttgaacattttcggccaggtaaccggaagtgtggactgcagaggtgacgttttggtcatgggccgtgtgaccggagatgtttccggcttgaatgtgagagtggaaggcgaggtaaacggaaacttaaccgtgaataaacgcctggacatgggccccggaggacggatcaagggagatattacggcgtccaatgttttcagtgaagggatcagcgaggggatattaaagcggaagagaccattcacctgggaggaagctctgtggtagtcggtaaggtttatgccaaggcatttgccattacacagggggccaggattaagggcatgatgacaacctacgactgataaacgactgccggggagaatactatgaacaaaagaaaaaaaagaaggcgtaaaccttactttggcagcgtacggtttttccggcatttgatacttacaacgatcgcattgcttatcatcattccaactggtctggctgcatattttaaggcccagaacaaaagaatggtgaaggaaagctatgagctatatagtgagaacctggtacttcaaaggcaggcagatatggcgttgaacagtgaaacggttaatgagacggaaccggtccgcctttcttctgacaaatacggggagatactggtggatacaaattcctgggaattgatgcttgtcaatgatgcccatcccttaagccagaagtttcaggtaaacctggttgaagtgcagccaggccagagcgtggattcacggatcgtcaaggacttacaggacatgatggaggcagctgaaaacgagggatatgaacttcatatctattcttcgtttcgtgatttaaaaaggcagcagtcactttttaatgattgtttaaagcgccttcaggaagaaggcatggattaccagcaggccttttatgagagcaaggcaaggctcgcactgccggggaccagcgagcatcagaccggtttggcggtggacattgcggcaaaggcttattattaccttgatgaggagcggggaggacagaaagaagccgtgtggctggagcaaaactgctaccgctacggttttgtgcttcgttatcctaaggacaaggagaatataacaggcatccgctatgagccggagcatttccgctacgtggggaagactgtggccagattccttacggaaaatgatctggtgctggaagaattttatgatattttacagaaaaacggcagactccgttagtttgcagggtgggattcctatggatcccgccctgttatttttggaaaaaaattctatgtgaaaacagtggggataaccattcatacttaacacacatcctgcataagtatgtaaaaacgtcctagcagggggattttcttgaaggaatatattgaagaacgcgcggttgcgatcgccaactacataatagactatcatgcaaccgtgaggcaaaccgcgaagaaatttgggatatccaaatctacggtacataaagatgttacggaccgactggaacacatcaatccgtccctggcagcccgagccagggtgatcctggatattaacaaatccgagcgccatatacggggcggcctggccaccaaagaaaaataccagcaccgtcttcagatgtgcagcaaaaagaattaataagacaaaggagtgaaaaacagcctctgatgggaagggaaccagcttcccatcagaggctgtttttaattcagagaaaattttagttgacatgagacctgaaaatatgttattctttaccccggtatgaagagacattatcgttttcatgcaaatattgaccacttcgtaagaagttaagcccagacggacaggcgggtcagctgccgagcgtgggaaaccacattattgattgagttaaaagctcaaattttataagttgattactttataatccgtgcgattgcacatcacttgtgaaacgatcaataatagcagggacaacatatttgctatgtagactcgaagacgataattatcatgacgaaaagatgggcattatgcctttattggaaatacagttcatgaaattgcaggcaggtgatgatttatcacctgcctttttgttattaaaaaattgcgtcccataaggtgacgtatccatttcagtgacaaaagaggggtaacattcccgtaacaaggaaaggtaaaatccatatgaacaaaaaagatcagatgagggcgcctatttatgaagctcttgaaacattccaaaaaaagagggtggtcccctttgatgtgccaggccataaaagaggaaggggaaatccggagcttgcccggcttttgggagaacggtgtgtgggacttgatgtgaactccatgaagcctcttgataatttatgtcatcccgtatccgtgatccgtgatgcggaacggctggcagcggaggcctttggggcggcagatgcatttttaatggtgggaggaaccacgtctgcggtacagagcatgatcctgtctgtctgcaaggcaggggataaaattattctgccgagaaatgttcatagaagcgctctgaatgctcttgtattatgcggggcaattccgatttatgtaaatccggaggtaaacagcatgctgggcatttcccttggcatggaaatcggccaggtggaaaaggcgatccaggaaaatcccgacgcagcggcggtgtttgtcaacaatcccacctattacggaatctgttctgatattcgttccattgtcaggctggcccatgcccatgggatgaaggtccttgccgacgaagctcacgggacccatctctattttggaaagggtcttccggtatccggtatggaagcaggggcagatatggcggcggtgtccatgcacaaatcagggggaagtttgacacaaagctccctgctccttttaaatgagggcgtgaatggggattatgtgcgtcagatcataaacttaacccagacaaccagcgcttcttacctgcttttgtcaagccttgatatatccaggcggaacctggccttaagaggggaagaatcctttgcaaaggtggtggaaatggcagaatatgccaggggagagatcaactccatcggagggtactatgcctatggaagggatttaatcaatggaaccagtatttttgattacgatgtgacaaagctttccgtctataccctggggaatgggctggccggaattgaggtttacgatctccttcgggatgaatatgatatccagatcgaattcggggatatctgcaatctccttgcctatatttccatcggcgacaggatacaggacattgaacgcctggtgggagccctggcggatattgagcgcctttataaaaaggacaggacaggaatgctgtcaggcgaatacatagcccccaaagtggtggtatcgcctcagaaggctttttattcccaaaaggtatcagtttctgtaggggaatccgcaggaaggatcagcggggagtttgtcatgtgttatcctcccggaattcccatcctggctccggggaaatgatcacggaagaaattgtggaatatatcatttatgccagggaaatgggctgttccatgcaggggacggaagacccggcggtggaacggctgatggtattaaaggagcagattcaggaaggggagaggtaagaaaaatggagatatggttttcaaaatttcacacttccaatgttaagctttccgttcggatcgacaaacagcttttttccggggagagtgagtaccagaggatcgacgtgttcgactcccaggaattcggaaagtttgtggcattggatggagacattgttttttctgaaaaggatgaatttatttacgatgaaatggtgacccacgttcccatggcggtccaccccaatgtaaaggatgtgctgatcatcggcggaggggatggaggagtggcaaaggagcttttacagtatccgtggatccggtccattgatgtggttgaaacggataagctgtttgtagacgtgtgccgggatatttttccggaggtatcctgcgggcttgctgatccaagggttaaggtctattatgatgacgggcttcgtttcttaagaagcaaaaaggaagaatatgacttaatcatcaatgattccacggatcccttcgggcatacggaagggctgtttaccaaggaattttacggaagctgttataaggcgctgcgaagtgacggaatcatggtttaccagcatggaagcccgttttatgatgaggatgaggcggcttgcaggagcatgcacaggaaggtgtaccggtccttccccataagccgggtttatcaggcccatattcccacctgcccgtcaggctactggctgtttgggtttgcttcaaaaaaatatcatcccatcaatgattttaagcgagatgcatggaaccagttgaaaattgaaacctggtactatacgaccaatcttcatatgggcgctttcatgctgccaaaatacgtagaagatttactggaagaggaggaaaaagaatgagcagattattaattatcggatgcggaggagttgcctccgttgcaatccacaaatgctgtcagaacagtgaggtgtttaccgacatctgtatcgcaagcaggacaaaggaaaaatgtgatgcattaaaggataagcttgcaggaacaacaaaaaccaggatcgagaccgccaaagtggatgcggatcacacggaagaggtcattgccctcataaaggattataagccggatgcagtgttaaacgtagctcttccttatcaggatttaaccatcatggatgcatgtctggcaacaggggtggattacattgataccgccaattttgaacctgagaataccgatgatccggagtggaaggcgatctatgagaagcgctgcaagagccttaaatttaccgccctttttgattattcctggcagtgggattataaggaacgttttgaagaggtgggtattaccgcccttcttggaaccgggtttgatcctggagttaccagcgtattttccgcttacgccttaaagcattattttgatgagatccataccatcgatattctggactgcaacgggggagatcatggatatccttttgcaaccaactttaaccctgagatcaacttaagagaagtatcttccaatggttcctattgggaggagggccgttggatcgagacagagcctatggagatcaaatccaaatacaatttccctgaggttggggaaaaggacatgtacttacttcaccatgaggagatcgaatccctggcaaagaatattccgggggttaaaaggatccgctttttcatgacctttggacaaagttatctgacccacatgaagtgcctggaaaacgtaggaatgctttccacctcccctgtggaatttaacggacaggaaatcgtgcctatccagtttttaaaggccctgcttcctgaccctgcttctcttggcccaaggaccaaaggaaagaccaacatcggctgcatttttacgggagtaaaggatggaaaggaaaagactatttacatttacaacgtatgcgaccatgaggaatgctataaggaagtggaatcccaggcaatttcttatacaaccggtgttccggccatgatcggcgccatgatggttctgaccggccagtggaagaaggcggggtattcaatgtggaagagtttgacccggatccctacatggaggctttaaacaaatggggacttccctgggtggtatgcgaggacccggaaaccgttaaggtatggagataggaaaaggatgaggatcgaggatttaaagaccccctgctatgtgatcgatgagggcaggctggagaaaaacctggaaatcttaagacagttaaaggaacataccggatgtaagatcctgctggcccagaaggcattttcctgctatgcagagtatccccttataggcagataccttgacgggaccactgccagcgggcttttcgaggccagactggggagggaggagatggggctggaaaaccacgtctttgctcctgcttataaggaagaagattttaaagagctggtgaagatctgcgaccacattgtgtttaattccttttcccagcttgagaaatataaggattccttaagcggggtggaggcaggcatcagaatcaatccccagtgttccacccaggaaggccatgagatttatgacccctgtgctcccggctcaaggcttggggttcccccggatcattttaaggaggagtggctgccaaggctttccgggctccatttccacaccttatgtgaacaaaattccgatgatttaaaaaagaccctggatgcggtggaggaaaggttcgggaagtatttatccggactgtcctggctgaatatgggcggaggacatcacatcaccagggaggattacgacatgggtctgctggaagattgtattatgagactaaaggagaaatacggccttacagtttatttagaaccaggagaggctgtggctcttaatgccgggtatctggtaacagaggtaatggatgtagtggaaaacgggatcaggactttgattcttgatgcttccgcagcctgccatatgcctgatgtgctggaaatgccatacaggcctcccttaaaggacagcggggagcctggagagaaggcatacacctacaggctgtcctcctgcacctgcctggcgggagatgtgatcggggattattcctttgacagggaaataaagccgggggataagctgtattttatggatatggccatttattccatggtaaagaacaatacctttaacgggatgcccctccctgcaatcgccgtcatggataaaggaggagactgccgtgttataaaaaggttcggctatgaggattttaagaaccggctggcctaggacaggcctgcatatccggttgattcatcaggagacagactatggaaaaattaaaaagccttccggcaaatgacggattttatatgccgggagaatttgaacctcatcggggctgtatcatgatctggcccaaacggcccggctcctggccctttggggccgggaaggccagggaggcctttgtcaggatcgcagaggctattgcggacagcgaacaggtgatcatgctggcagaggacgatgtgagggaaagcgccagagaaatgctttcggaccggatccaggtggttgatatggaatctgacgatgcgtgggcaagagatgtgggtcctacttttgtggtaaataaggaacgtgaggtcagagggatcgactggcagtttaacgcctggggcgggacctttgacggactgtatcctgactggcaaaaggataacctgcttgcagggcatttttgtcagcggtttggatatccggtttatgatgccgggcattttgtcctggagggaggttccattcactccgacggggaaggcacacttttggtgaccgagagctgccttttaagcgccggaaggaacccctccctgtcaaagcttcaaattgaggaacagctgaaaacctatctgggtgcctctaagatcatctggctgaaggcaggcatctatcaggatgaaacaaatgagcacgtagacaatgtctgtgcttttgtacggccgggagaggtggttttagcctggacggatgagagagatgatcctcagtatgaaatgtccctggctgatttaaggattctggaaacggagacggatgcagcaggaaggcattttaagatccacaagcttcccatacccaaagaaccggtctgcatcacagaggaggagctttccggcttctcctttgagccaggagaggatgtgagggaggcaggtgagcgcctggccgccagctatgtgaatttttacatatcaaacggcggggtaattgtcccacagtttggagatgcccacgactcagaggcagtacggatattggaggagtgcttcccggagaggaggatctatccggtgtatgcaagagatatcattgtgggaggcgggaacattcactgcattacacagcagataccggaaggagagtttcatgagagaagtaacagtggcagcagttcagatgaagtgctgggatgacgttaagaaaaatattgaaaacgcggaaatgctggtaaggcaggcggcaaaggaaggcgcaaaggtcatcctccttccggagctgtttgaacggcagtatttctgccaggaacggcggtatgaattctatgactatgcaggaccggtggaagaaaaccaggcagtgaagcatttttcccggatcgcggctgagctttctgtggtccttcccatcagcttttatgagcagtccgggaattccatgtttaactcggcagcagtccttgacggagatggcacaaatcttggggtataccgaaagacccatattccggatgaccattactaccaggaaaaattttatttcacgcccggagataccggattccgggtatttgataccatgtacggaaaaataggggtagggatctgctgggaccagtggtttcctgagacagcaaggtgtctggctttaaacggggctgagctgatcctgtacccaactgccatcggaagcgagccgattctggaatgtgacagcatggagcactggaggcgctgcatgcaggggcatgctgcctccaacatcatcccggtggctgctgcaaaccgggtgggagtggaatctgtgattccctgcgcggaaaatgggaatcaaagctcttcccttaaattttatggctcttcctttattacggacagcaccggggcaatcatagcatccatggacagggagaaagagggtattatatgtgcttcctttgaccttgaccagatcatggctgaccggaggaactgggggcttttcagagaccgcaggccaaagatgtacggagaaattacaggaaaatcttaaactcacttttttgtgcaaggaaagttgcgataattcaatgagactatactatactgaagctgtcacaagatgatgggaggtaagcgtgtggattggctggagaaaatgaacggagccctggaatacattgaagacaatttaagcggagagattcatctggaggaggcggccaaacgggcctgctgttccagctttaatttccagcggatgttttcttttatggcagacgtatccttggcggactacatcagaaggaggaggctttcccttgctgccatggaccttctgacgacagaagaaaaggtcattgacattgccgtaaagtatggatatgagtctccggtttcctttgccagggcattttatgccatgcacgggttaaatcccagggatgtgagaaagcccggtgggaaggtcaaggcttatccccgcatctcatttgaaataaccataaaaggagctgaagctatgaattattgcgtaaaagagttgggagaatttaggctggtaggatttaaggaaaaaatatccatggaaaatggagagaattttaaaaggatcccggagttctggaatgaggtttgcaggcagggcaggtatgaaaaaatgctgggctataatgacaataaggagctgtactccatgggagtgtgcaccaattccgatgacggcagggattttgattattacattgccaccggatcagacagggaaataccgggagatatggctgaactggtaattccggccggcacctatgtgatctttgaatgcataggccggatgccggaaggccagcagaaggtatggaagcgggtttttacggagtggtttccgtcctccggctatgaaataatggatggtccgcagctggagtggtattccgaaggggatattacttccgaggaataccggagtgaaatctggatccctatccgcaaaaaggcgtaaatctgttcataaaatcggctcactccccatatatatagtaataatcaataagttggggagtgtgctatgaagagactgtttagcagaaaatggatgatttttttcggcctgaccatgtgggtattggttgtgcgtaccttaagcgggtgtactttaaacggggatagtggggataaagtgcgggatctggaatttaccgttgtagctgacgcggatattccgcaggaacttagacagatcattgctgaaaagcagcagtcgccctttaagctgacctacagcgatgatcagaacctttacatagtagttggttacggaaaacaggccagcggaggatatagcatcgcagtcaatgaactgtatttgacggataattccattgtcctggacacggaattaatcggaccggaaaaggggagaatacgggggcagaaccctcctatccattcatcgtcattaaaacagagatgtcggagcttccggtggtgtttcagtagaaaaaatggaaaaagacagccgttccgcagatggcaaaagcgggacggctgtttttgcggagatattaaaattccccttttttcttaggccgtcatatgatatactacttcaaacaggagtaggcagtaaggaaaagaggaaggtatatgatattaaaggatatatggcttgatgtgacggcagtaaaagagcgggatccggcagccagaagcaagctggaagtgctcttgctgtatcagggagttcatgcattgatctggcatcggtttgcccactggttttaccagcacaagatgttttttgtcgccaggcttatttcccagctggcaagattctttacactgatcgagatccatccggggcacagctggggcacggaattttaattgaccacggctgcggagtggtaatcggagaaactacggtggtaggcgataactgtaccatttaccagggggtgactctgggaggcgtaggactgaataagggaaaacgccatccaacacttggcaacaatgtgtcggtaggagcaggtgccaagattttagggtcctttgaagtgggtgataattgtaccatagcggcaaatgccgtgcttttaaaacctttggagagcaacgtaacagcggtggggatccccgcccgcccggttaagatcgacggcgtgcccattccaaagaaacaagataatctggtgacaatggatcactactgtaagatggaagagcgggtcaaggaactggaagaaagacttcttaagctgcagacagagctgtcctcatacagggaaaaggaaacggaagccgggacagaggcttctcccgaagaaaaaccagaagaataaaagtgcccaaatctccctgtttttccgtaaataggggaatggtaacaaaaaaagtataatgaaacatgcacctgcataaactttcttaaaggaataaagaaggtaaggcaggtgcttttttatgttggagctggtgaagaaaaacatacatatgaatcgctggaaaggaaatgctacgtctcagattactcttgacgatgacttcatcgtcccggacagcatggatgatgtggatcagattattttaagttccggtgaaattactattgattccgtaaaaaaccagacagagcgcgtcgcggtccggggcaagctggactttatgatcctctatcggggagcggaaggagggattcagaccctttcaggaagcattaactttgaggaacccatcaatgtgcctggactggaggaaaaggattatgtccagctggcatgggagcttgaggatttgaacgcaggaattattaattccaggaagctgagtgtaaaggctattgtaacccttagggtgaaggtagagaccgtcagcgatgttaatgctgccgttgaagtggacacgggaagcgcatcttctgacgcgccttcggtggaaactctccgccgcagcctggatgtggcttccgttgcgctccgccacaaggatacgttccggatcaaggataccattaccctgtcaggaaacaagccgaacattgatcatgttttgtggactgaaatgaagctaagaggcattaccacaaggcctatggatggaaaaatgatgcttgacggggagctgctggtatttgttatttaccagggagaaggagaaggagctccgatccagtgggtcgaggaaagcattccattttcaggagagctggatgttccggatatgactgaggatatggttcctgtgatcatggtccatctgatccataaggatatagaagcaaagccggattctgacggcgagatgcgtgaaatggatgtggacgcagttcttgaattggatatgaagctttacaaggaagagaatatggagctgctcagtgacttatattctactaaccgggaactgacgcttcagacaggagaagcttgttttgataagatcctgacgaaaaatatgagcaagtgcaagatcgtggaaaagatcagcctggatcaggcggagaggatcctgcagatatgccacagtgagggaatcgttaaaattgatgatacggaaatcagagaagacggacttcatgtggaaggcgttttggaggtgcgggtcttatatctgacctctgacgatactcagccgattcagtcgtctgtagaggatatccccttccatttcctgattgaggctccggggatcaatgaggataccatctgtcagttaaatccgggcttagagcagctgggcgctgttatgatgggcggagggacccttgaagtgaaggcgaccatttcccttgatttactggccctgcagccggtctgcgagcagatcatcataaatgtagcggaagctcccatggatttaaacaatctgcagaaactgccgggaatcgtgggatacattgtacagcctggagattctctttggaaggttgccaaaaaatttcatacaacaattgataccattatagcaactaacagtttgacggaaaaatctgtaaaaccgggggaccggctgattctagtgaaagaattggcataaataccttaattgagatgccaggcaaaagaattcacttttgcctggcataattgattttatctttgaatgattttttcaaaaaagggcaagataaagattgctattcacatatcagcttgccctgttatataatatactatagctaagctatagcttcaaccatcgatggcgccaaaacgcatccagctggtgcttaagatagatgacaggttaccctggacggtagtgacgtgattgcaaggcgttattaccgtttacatatcctgaatttcctataccggagaatgaagaacatgaattacacctatattttaaaatgtgcagatgatactctgtactgcggttggacaaaccatttggagaaacgcttaacagcccataaccagggaaaaggagccaaatacacaaaagcccgcaggccagtggttttagcttattgggaagaattttccacaaaggaagaggccatgcgccgtgaagctgccataaaaaagctttccaggaaggacaagctaaagctcatgggagagattgtatgagaaaaaccgccagggccgcaaaatcgcgggactgacggtttttaccattctatgcaacaaaatgatacatcagaatataatggcacaagcttcctcccatgacgaaaagatggaaaatctcatgggaaccgaaacttttgtgttttgcgttaaaaagaggaagcttcagggcataaatgataccgcccagggtgtagatgacgcctccggctacaagccagaggaacccggcaggagagagggcatccatgatctttgtaaatgccaggacacatacccagcccatggcaatgtaaaggctggaagaaaaccatttggggcacatgataaagcaggcttttatgataatccctgaaacagcaattccccatacaagagccatcaggctccagccggtctgatctccaagaacgatcaggcaaaccggcgtgtaggttcctgcgatcaggatgaaaatcatcatatgatctattttttttaacagccggttgattttcggtgaaatgtcaagggtatggtagatggtgctggccgcataaagaaagaccatgctgaggataaagaccgttaaggcagccaggtggagctttccatcggaggaagccttaatgagcagcggtattgcggcgatgagcgccattatcatggcgacaaagtgagtgatggcactgactggatctttgattttaatttccataagaaacctccttgtagataataaaaacttgtaacgtagtaattaatactatgtattatatttttatatactatacactcaaaatggaaaaaatgcaactgttttttaaccgaatcaagaaagttcccgcttgcaaatacctgcttgacaatagaaagtgtaaaaatgggtttgccatattgggaacaataaaatataatggatagataaaatataattcaggaaaaggaaggtatgaccgccttatgaatcagacgataaaagaactgatggaaagaaaatccgtccgggtgtacgaggacagggtcattgagccagagaaaaaggcggctattatagatgcagccttacaggctcccactgccgggaacatgactttgtattccatcattgatgtgacggaccagaagcggaaggagaccctggcagtgacctgcgacaaccagccctttatcgcaaaggccccgctggtgctggtttttgtggcggattaccagaggtggtatgagctgttctgtcattatgaagaggaggtccgaaagccagggcttggagatcttttgctggcctgtgacgatgcgctgatagcggcccagaatgcggttgtggcggcagaatcccttggtattggctcctgctacatcggagatattatggagcagtatgaaacacacagggatttatttggccttcctaagtatgcagttccggcggcaatggtggtctttgggtatccgaccaagcagcagatggacagaaagaaaccggtgcggcttaagcctgaagccgtggtgtttgagaattcttaccgccgtttaagccctgaggaattttccggggagcttaaaacgattcagggaagggaagaggatttcgaacgctgggtaaaggcattttgcatgcgtaaatggaattctgctttcagcgctgaaatgagccgttccgtggaggccatgatggcgtcatggaagaaagtggagtaaggaaaaaggatggagcttaacatattatacgaggatgaagacatactggtggcggaaaagccggtgggaatggaatcccagtcttccagatcatttgagccggacatggtcagcgaggtaaggaaacatatcaacagtttatccccaaagtcagacccgccatatgtgggagttatccacaggctggataagccggtgggaggcgtcatggtttatgcaaaaacgaaaaatgccgcagagtctttaagcaggcaggtttcccagcatcaaatggagaaaatctactacgcggtggtttgtggaaaacctgtggaaaactttggggcctacgtggattatttgtggaaggacggaaaaaccaattgttccaaaattgtggataaggggataaaaggtgcaaaactggcggagcttcattatcaggttgtggataaccggagcatagggaatgaagaatgcagccttacaaagatcatattaaaaaccggccgtcatcaccagatacgggtgcagatggccggccacggcacacccctttggggtgaccgtaagtataatcccggttttcaaaagggagctgacggcaaacatgtggccttgtttgctcacagcctgtcattttcccatccaggcacaaagaaaaggctgagtttttccgtgaaaccaaagggagaaatctttgaaatgttctcattgccggaaatgacataaagaaggaattttttgctaaacggatttcgcatattttcattccgtatggctcataatagtgattgtacaaaagaagtacaaatcagaaacaggtgagtccatggtgaaaccgagcaggaaactgaagaaaacattattaatattgggagttacaggggcagtgtatttaagttttcgctatctgctgccccttgtgattccctttttgattgcatacgtatttgctctgtcccttcggccttcagccctttggatcgagaaaaagacccgcttcatcataaagggtagggtgatttccattcccctggcagttatcgggggagtagaagttatcctttttatgatcgctgttggaatcatcctttatgtggcagggagaaagctgttcatggaagccaggcttttacttcagaacctgccggtcattctggaaggcatggaccggtggcttatggataactgcttctttgcggagcggtttttaaagctgcctgacggatatatggtagaagtggtaagggacattatatcaggtggacaggttgctataaaaagcaggatcatgccctttcttatgacgaactccatgaccatcatgaaatggatcgtacaggtaacggtgatcattatcatattgctgattgccacggttctttcccttcaggagatggatgacatcagggaaaggcgggataattccatgtttcgctttgaatatgccatgcttgggagacggctgacaacggtgggaagcgcctggttaaagacccagggagctatcatgctgtttactatgacggtgtgttcggcagggctgtttttcctgggaaacccttattttattttatttgggatcgggatcgggcttttggatgcgcttccgatttttggcacagggacagtgttcattccctgggcccttttctccatgatcaataaaaactggaagtacggaatcggattaatggtcatttatattatctgttattttctgcgggagatcatggaagccaagatcatgggcggaaaggttgggcttacgcctttggaaacccttgcatccatgtatgtgggccttcagcttttcgggcttttgggatttattcttgggcctatcggcttattgattgtggaagatattgtagaggtgtatgagggctggtgctgtgaagataggaaggaaatggcagattcggaggaatgaatcagatgacctacttgacaaacatttgcaaataacgtaaaatcaaccatacaatctttttcataatgaagaaataagacgttgaagaggaccagtaagtgatgaagtattccagagagaaggctgtgtgctggaaggcctttatacctctcatgacccaacctccctcggagtcccgcagcaaactgcggcgcatttcctgcgttacgggataggaaaagtgagtcgtggaaatttccatggctaaattgggtggcaccgccgagctgttcggtcccttttttagggaacggatggctctttttgattttatgaaagcaccaattatgccccaaaagcttgggcagtaaataggagaggagaacttgttatggcaaaggacaagaaattagtagaagcgatcacatccatggaggtggatttcgcccagtggtacaccgatgtagtaaagaaagcggaattgatcgattattccagcgtaaaaggctgcatggccattaagccggcaggatatgccatctgggaaaatattcaaagcgagcttgacagaagatttaaggaagtaggggtggaaaatgtttacatgcctatgtttattccggagagccttcttcaaaaggaaaaggatcatgtagagggatttgctcctgaagtcgcctgggtgacccatggaggtttggagccgctgcaggaaaggctttgcgtcagacctacctctgaaactctgttctgtgatttttactccagagagatccagtcttaccgggatttgccgaagctttataaccagtggtgttcggtagtgcgctgggaaaagaccaccagaccgtttttacgttccagagagtttttgtggcaggaaggccatactgcccatgctacggctgaagaagcggaagcccggacagagcagatgcttcatttatatgcggatttctgtgaggaggtccttgcaatgccagttgtccgtggccagaagacagataaggagaaatttgcgggagcagaggcaacctataccatcgaggctttgatgcatgacggcaaggcacttcagtcaggaaccagccataactttggaagcggatttgcaaaggcctttgaaatccagtattccgataaggaaaataagcttcagtatgttcatcagacttcctggggaatgacgaccaggcttattggtgccatcatcatggtccatggtgatgacaacggccttgtgcttcctcccagaatcgcacctattcaggtggtcatcgttccggttcagcagcaaaaggaaggcgttcttgacaaggcatatgagttaaaacaggttctttctaattataaggttaaggtggatgactccgataagagccctggctggaaattcagcgaatcagagatgagaggcattccggtccgtgtggagatcggacccagagatatttcagaaaaccaggcggttttggtacgccgtgatacccatgagaagatcaccgtatccttagacgagttaaatgctaaggtaggccagcttctggaaaccattcagaaggatatgctggaaagagccagagctcaccgggatgcccatacctatgaggcaacggacatggatacccttgttaagaccgtagaggaaaagccgggctttgtaaaggccatgtggtgcggctctcaggaatgtgaggataagatcaaggagatcacaggggcgacatcccgctgtatgccatttaagcaggaaaagctggcagaaacctgtgtatgctgcggaaaacctgcggtaaagatggtttattggggcagggcgtattaataccggcaagacaggaaaatcaggaggtggcaaagtgataacgattcaggttccggaagcggcaaaaaggatcatcgaacaactgaataccaacggctttgaagcttatgtggtgggaggctgtgtgagagacagccttttgggccggacgccggaagactgggatatcaccacctcggcaaagccggaacaggtaaaggaaatttttaagcggacggtggatacgggaatccagcacggcacggttacagtgcttattgatcatgagggatatgaggtaaccacctaccgcgtcgacggggagtatgaggatgggcgccatcccaaatccgtggaatttacaggaagcttattagaggatttaaagcgccgggattttaccatcaatgcaatggcttacagcgaccgggaagggctggtagatgcctttgacggggtaaaggatttagaaggccagaccattcggtgcgtgggaaatgctgtggaccggtttacagaggatgctttgaggatcttaagggccatccgcttttcagcccagctgggctttgacctggaagaggaaaccagggcagcaattgccgtcatcgcccccaacatggcaaaggtcagtaaggaacggatacaggtggagcttacaaagctcctcctttctgacaaccccgggaagcttaaatgtgtgtatgaaaatggaatcggcccttatatctctgaccatttcgaacatgcgggaaggcggcttctggaagcggaaaagctggcctggctgccccttaaaaaacacctgcgctggtcaggctttttaaggctggaggagcctcaggatgccgtccggatccttaaggagcttaaactggataatgagaccattcatcagacaaaaactcttgtcagcttatggaaaacagagattccggcggataaggcagccatccggcaggtcatgagcggcctttccccggagctgtttcaggatcttttgtgttttcaaaaggtattttgtcctgaaacctataaggcccaattaaatatggtggagcaatattccggggaaatcctaagtgccggggattgcatccgcttgaaagacatggcagtcaccggccgggaattgatggatgcaggcatgaagccggggcctgaaatgggggcggtattagaccatttgttccagctggtccttacgcagccggaatgcaataacagggaatatctgatgaaatcagcagaacatttattaaaggaacaagcctgaggcacgtataactttccgccgtattttgcatatttttttccacctcttcataccctagaagtagctgatgagctaagagttggaggggtggttgtgaacgagaaatacacagaggtgctttcgcagtatgagcttgaaattctggatgtgaaacgcggccggggcgcctggctgtgtgaaacgaaccaggggcttaaactgcttcgggaatataaaggaaccttaaagcgcctggaatttgaggatcaggtattttcacagatgaaagagacctgtcatttaaacgtagaccgctacgtcaggaataaagatggtgaactcctctccagtgccgaggatggaacccggtggattgtaaaagactggtatgcggaccgggaatgtaatttgaaagatagcaaagaggtattatgtgccatcgaacaaattgcttctttacataaagtgctgcggcggatcgaatttaaagaggaatggaacttaggatccatattggtacaacagccggctgaggaaatggaacgccacaaccgggagctggtgcgcgcccgcacgttcatccggaataaaaggaaaaagtctgagttcgaattgtgcgttatgggaaattacgacatatttttcgaacaggccatggaagcctgtaaagggatggcaggcttttatgaaaaccggggtgacagtgaggaatacttatgtcacggagacttaaaccagcatcacatcctcatgtgctttcatgatgtggccattgtggaattcaaccgcatgcacaagggcatgcagatggaggatttataccattttatgcggaaggccatggaaaagcatgactggaatttaaagcttggtatggccatgctggaaacctatacaaaggttctccctctttcggatgcagacaggatatgcctttactatttgttcttatatcctgagaaatactggaagcagatcaacttttattataacgccaataaggcctggattcctgcacggaatattgaaaagcttaaggatttagagattcagcagcccatgcggaatcttttcctgtcacggatcaaggattgaaagaaacgcgcctttcaatcttgggttcaaggcacaaaataatggaaatacgcttttcttttaacctgttatgatttataatagccataacagaaatggagagaaaggagtattttgcttatgaaagattacaagagtatttatgaggaatggcttttaaatccttattttgatgatgcgactaaagaagaactccgggggatcgcagatgatgaaaacgaaatcaaagagcgtttctatcaggatctggaatttggcactgccggtttaagaggcatcattggcgccggtatcaaccggatgaatatttatgtagttagaaaagccacccaggggcttgcaaattatatcataagccagggcggagccgataaaggtgtggctattgcatacgattccagacatatgtctccggaatttgcagaggaagcagcgcttacgctggcagccaatggaattaagacatataaattcgaatctctgcgcccaacgccggagctttcttttgctgtaagggaattaggctgtattgccggaatcaatattaccgccagccacaaccctccggaatataacggatacaaggtatactgggaggatggcgcccagtttactccgcctcatgacaaaggggtgaccgcagaggttttaaatatcacggatatatcaacggtcaagaccaccaccttggaagcggcaaaagaatcaggaaaatatgagatcatcggagctgctctggatgacaaatatatagcccacgtaaaagcccaggtagtgaatcaggccgcaatagaccagatgcagaatgatattaaaattgtttatactcctctccatggtacaggcaatcttcccgcaagaagagcgttaaaggaaataggatttacgcatgtgtatgtggttcctgaacaggaactgcccgatggtggttttccaacggtcagctatcccaatcctgaagccgaggaagcgtttgaactgggccttgcccttgcaaaggaaaaggatgcggacctggttctggcaacggacccggatgctgaccgtcttggggtgtatgtaaaggatgacaaatccggagaatacatccccttgaccggcaatatgtccggttctcttctgtgcgagtatgtattgagccagaagaaggaacggggagagatccccgcagatggacaggtagtaaaatccattgttaccaccaatctggtggatgcggttgccaaggcttacggctgtgagctgatcgaggttttaaccggctttaaatacattggccagcagattttaaaggaagaggccaccggatacgggacctatatgttcggtctggaggaaagctatggctgtctcatcggaacctatgcccgcgataaggatgccatatccgcaacggtcgctttgtgcgaggctgcggcttattataagacaaagggcatgaccttatgggatgccatgattgccatgtatgagaagtacggctattataaggacgcagtaaagtccattggcttaaagggtattgagggccaggaaaagatccggacgatcatggagaccatgcgtaaggatacaccggcagaggttggcggatataaagtcctttccgccagggattataagcttgatacggtaaaggatatgagcaccggagaagtcagccccaccgggcttccccagtctgacgtgctttattatgatctgacggaggatgcatggctgtgcgtaaggccatcaggaacagagccgaagatcaaattttattatggcattaagggcgcttccatggcagaggcggaggagagatccgcgaagctgggagaagcggtcatggctatggttgataagatgatgtaatgagcacaagtgagccaagatgagcgtgctcatcggcgcgaacggtgaatgctgaccatgattcccagaatcatgacataagaaaatataaaattgagacggagcctggtcaaaaaaccaggctccgtctttataaattatgattttttgtattttttggagtattcctttaattcctttaaagcctccccaaacagccgggatgaagcggtagggttccggcggagaataccttttcggtaaaaggtcaggcgtccgctgagcttttctttggtttctgtcagggactgaaggcgttctgctaaagcggattcttttaaggcactggcagtttcggccttcagagaggagatctttaccatggtcccatcctttaagctggctgctttttgaatggtttcagtttttaaatcggataccttctgggcggtttcggcctttaacagagcgatctgcacctgtacctcttctagctctgattttaattttgtcatggactccaggattcggccaaggtccagggcttccttggtggagtgtatggcatcagtgacaaaaagactgccgatcacgatcacaagggcgatgcacaccgtcccgtttaaatcaaggaccagccattccagggacggtgaatgacctccgtcagcagcagggtgagaaagccccatgcaatggaggtaccaagacagacataaccgtttaaattaaagggcttgctgctgtagtcccagtatttcattttaaacagccgttccatggcatagccggtggcatattccagggcagaggcacctgccataccaaagagaaatacaagaaataaattgccctggacgggcagggacagccacagcatgataatggcaccgcttccatacaggggaagaaggggaagccttagaaaaccgcggtttacaaaatgaaagctttttacggatacataggtggattcgatgatccagccgataaaacagtatatgaaaaaaaacagcagccactgataccaagtatacaagtacataatagaaccctttcttcaaaatatttctgttggatttatcataaacggttttgtcattttttgcaacctttgcttgctttaatcgcttctgtcatgtagaattatgatgtttcgtatttagaatgatgaaaccctgtgaaaagtcaaggaacactgtaaagataagagaaaatcaaaccgcattaataaaggagtttttcaatgagcatattaaacgtagaacatctgacccatggatttggagaccgtgccatttttcaggatgtatccttccgcctcttaaaaggagagcacatcggcatgatcggagccaatggagaaggaaaatcctcatttatgaatataatcaccggaacactacagccggacgaaggaaaggtggaatgggccaaacgggtccgcgtaggttatttggaccagcatacggtgctggaaaaggggatgaccatccgggacgtattaaaaagcgcctttgcattcctgttccagatggaagagcagatgaatgagatctgtgataaaatgggagaggctgatgaggaaaccatggcttccatgatggaggagcttggaaccattcaggaccttcttatggcccatgacttttatattattgattcaaaggtagaggaagtggccagggctttaggcttaaccgacatggggctggataaggatgtgacggaattaagcggaggccagaggaccaagattcttttaggaaagcttttattggaaaagccggatatccttcttcttgatgagccgaccaattatctggatgaacagcatattgaatggctgaagcgttatctccaggaatatgaaaatgcattcatcctgatttcccatgacattccattcttaaacagcgtggtcaacatcatttaccatatggaaaaccagagcctggaccgttatgtaggtgactatgaaaagttccaggaagtgtatgcagtgaaacgttcgcagctggaggctgcttataaaaggcagcagcaggaaatcgctgagctggaagattttgttgccagaaacaaggcccgtgtgtccaccagaaacatggccatgtccagacaaaagaagctggataaaatggaggtcattgagctatcaaaagataagccaaagccggaatttcattttatggaagcccgcacagccggtaaatgcatttttgaaacaaaagatatggtcatcggctatgaggagcctttgtcaagacctttgaatctttccatggaacgtggggaaaaggtgattttagcaggcgcaaacggcataggaaagaccacccttttaaagagcatcctggggctagtgccgtccttagagggaaatgtggagcttggagattacctttccatcggatactttgaacaggaaatggcccccggaaataccactacctgcattgaagagatctggaaggagttcccatcctacacccagtaccaggtccggtctgctcttgccaagtgcggtctgactaccaagcacattgaaagccaggtgcgggtgttaagcggcggggaacaggcaaaggtcagattatgtaaacttcttaaccgggaaacaaatgtccttcttctggacgagcctaccaaccacctggatgtggaggcaaaggaagagttaaagagagccttaaaggagtataagggaagcattcttttgatttgtcatgagccggaattctatgaagggatcgcgaccagagtgattgactgcagggaatgggcccttagattatcttgatatgatactgatggagaagccaggaaaaacatgttttaaagtttttccaggttgacgcggcatctgccgaatgaatatgcttgcaaattcatttggctcgctgcccgcgcacataaaaatcggggcctggctcttttaggaaccgggccccaaattaagtattgcgattgggaatggtaggtatataaaataagagaatgttcttttaggggggccggacggctcgcgccgtccggtatgagtatgaaaaagctttgtgatttcaagtaagttacttgaaacaaaaggcccgttatccttccggataacgtattattagtatacgaggaaattgtgactaaaatgtgtaccacatattaaaaaaaaataaacataataaaaattaaaaaaagcctttgaattcccagggttattgtatataataaagtagaaactgtgacttcaattacgaattagccataattttgaagataaaggaaaccctgggaacaggatacagcgaacaggaggaagcaagatgatgatgtccaatgatattggaatcgatttaggtacagcaagcatactggtttatattaagggaaagggagttgtattaaaggaaccttcggttgtagccattgaccgtgatacaaataaaatcaaagccattggagaggaagccagactgatgatcggaagaacaccgggcaacattgtggcggtaagacctcttcgtcagggcgttatttctgattatacagtaacagaaaaaatgctgaaatattttattaacaaagcggttggtaaaaagactctgagaaagccaaggatcagcgtctgtatcccaagcggtgccactgaggtagagaaaaaggcggtagaggatgccacttatcaggcaggggccagagaggtggcgatcattgaggagccggtggcagcagccattggtgctggaatcgacattgcaaaggcatgcggaaacatgatcgttgatatcggaggaggaacctctgatattgctgttatttccctgggaggtacggttgtaagcacctccatcaaggttgcgggagatgattttgatgaagccctcgtccgttatatgcgaaaaaaacataaccttttgatcggtgagaggacggctgaggaaatcaagatcaacatcggtgcggcatacagaaggcctgaggtcctgaccatggaggttcgtggacgaaacctggttaccggcctgccaaagaccattgtagtcacttccgacgagactctggatgcattaaaagaaccggccatgcaaatcgttgatgcggttcataatgtactggagcgcactccaccggagctggcggcggatatttttgaccgtgggatcgtgcttaccggaggcggctctctcttaagcggcctggatgccctgattgaagagaagacgggaatcaccaccatgatcgcagaggatccgctgactgcagttgccattggaacaggaaaatttattgaattcatgcatggcggagataataaaacagaattttaacccaaaaacagggctgataggaatatcagtcctgccttgaggttaccaggactgctttggaacgaccctgtcggcatcgtaagattccggcggggctggttttgaggcagtccgcttgtatttgtacgggaggaaccatggcaacagtctgcggatttgtggagaaaattaaatacaggaacgaggacaacggctacacagtcttaagccttgtaaatgcaggggaagagtatactctggtgggcagtttccactacataaatgaaggagaaatgatcgaagccgttggggttatgaccgagcatccggtttatggggagcagatgactgtagaaagctatgagatcaaggctccggaggacactgcggcaatggaacggtacttaggttcaggggccatcaagggaatcggggcagctttggctgccaggatcgtccgccgctttaaagccgacaccttccgcgtcatggaggaggagccggaacggctttctgaagtaaagggcgtcagcgaaaagatggcaatgtccatttcccagcagatagaggaaaaaaaggagatgcgtcaggccatgatgtttcttcaggaatatggaatttccatgaatctggcggtaaagatctaccatgaatacggtcccaggctttacagcgtattaaaggaaaacccttaccagctggcagatgacattccgggcgtaggatttaaaatggcagatgaaattgcgagaaaagcaggaattttcacggattccaattttcgcatcaaaagcggggtgctgtacactcttctgcaggccacgtcaaacggccatacctatctgccggaagaagaacttttgtctcaggcttcggagcttcttaggatagaaccctcttttatagaaaagcatttgatggacatgcagctggataaacgccttgtcatccgggaatcggaaggcaaacgcatcgtttacgcctcccagtactattacatggaactgaacgtggcaaagatgcttcacgatttaaatatcaggggtcaaatgcccgaggaggagatccggacccagcttcttaagatccaaaaggaagggcagatcgagctggatgaaaaacaggtccaggcggttgtggaggcggtcaacagcgggcttcttatcatcaccggaggcccgggtaccggtaagactaccaccatcaacaccatcatacggttttttgaaagcgaggagatggagatcctgctggctgctcccaccggcagggcggcaaagaggatgacggaagccaccgggtatgaggccaggaccatccaccggcttttggagctgaccggagttccgggagacgatcgttccgttggaatgcattttgaccggaatgaagaaaatcccctggatgccgacgcggtgatcatcgatgagacctccatggtggacattcatttgatgcagtctcttttaaaagcggtcaatccggggacaaggcttattctggtgggagatgtgaaccagcttcccagcgttggccccggaaacgtgctccgggacatgattgattcaggaagttttaacgtagtcatgctgactaagattttccgtcaggcaactcaaagcgacattgtggtcaatgcccacaagatcaatcggggtgagcaggttcctttagggaaaaagagcaatgatttcctctttatcaagagagaggatcctaataccatcatcaatgccatgatcactctggttcaggacaagctgcccggctatgtccatgcaaaaacttatgatatccagatcatgacgccaatgagaaaaggggccattggtgtggaacggcttaactccattttgcaggaatatttaaatcctcccggagaaggaaaggctgaaaaggaatcagccggagtcacctaccgggtgggagataaggttatgcagatcaagaacaattataacattgagtgggaggtccgcaacggatacgggatccctgttgataagggaacgggcatttacaatggggatatgggcattatccgggagatcaatacatttgccgagctggtaaccgtggaattcgacgaggggcgtatggtggattacagctttaagcagctggaggagctggagcttgcttacgccattacgatccacaaatctcagggaagcgaatacccggcagttgtcatccccatattttccggtccaaggatgctcatgaccagaaacttgatctacaccgcggtaacccgtgcaaaatcctgcgtttgtctggtgggaatgccggaagtattcggggaaatggtgaacaatgaaatggaacagcggagatattccggtttaaaggaccggatctgcgaaatcagcaggctgtcataattgagagaaacaggctttatgtgtttctctcgttatggcggtagttgccgggtgaataggcggccctgatcgttagccatgccactggcggaaattctttgggcagacagtctttgtatgaatctgcttatcttataattcttttaattctattcgttctataaggagaatcttttatatgtacccttcgttttttattgatttgttatttcccagacgatgccctgtctgtgacgggatcgttatgccaaagggcaggctgatctgccgggaatgcatgaaaaagctgtcatttgtcaaggatcctgtctgtaaaaggtgcggcaaggaggttataagctctgacatggaatattgctttgactgtgtcaggcacaagcgcacttttgagtatggcagggcgcttataaattatgacgaaagagccggaagatccatggcaaaaattaaatataggaataagagggagtatttagacttttatggggaagcaatttgtgccaggtactggaaagtgatcaggcgcatgaaggcaaatgtccttgttcctgttccggtccatccttcccggaaaagggagaggggatttaaccaggcagagcttttggcacgcaggatcggagaaggccttgggatgcctgtttaccctcaaatgctggtcagaaataaaaggacaatgccccaaaaagggcttgacccggcgggcaggcttaaaaatctggaggaggcattttctgccggggaaattttaaaaggagtggaaggggtgattttagtagatgatatttatactactggaagcaccatagaggcatgtacccgggcgcttaaaaaagcaggaataaaaagggtatattttctcacgatttgtattggacggggacagtagattgatgtatgatagcaggtgataaaagcaatcaggcctaggaggaacatatatgataatcagaactgcagaagaaaaggatatgccggagcttttgaacatttataattatgaggtagaacatggactggccacatttgacttaaatccgaaaaccatggaggagcggttggtctggttccgggaacataacgtgggaaaccatcctttgattgtagctgaagaagatggaaaagcagtggggtatgcaagcctttcctcttatcgccccaaagaggcttatggggccacggtggagctgtctgtatacattgataaggattatcgccgcagagggatcgccggggagctgtcgtttgctattcttgagattgccaaggaacgggacgatattcatacggtcatttcagttataaccggaggaaacgaagcgagcataaagctccatgagagactggggtttgttcattgcgggactataagggaagtgggcgtgaagtttgggaagatgctggatattgagaattatcagttgatggtttagaagataagtgaaatttagaagtcagatatgaaagggacgcattgcactccatctttaaatgtggagagtgcaatgcgcccctttttatccttatctgtcatcacaggctttcataaatagttttaacaggtccaatgcataacgtcgtttcttatcactgcattgcccaaggatgttaatgatggtttgctgttcaatcagaagtgaactggtttctgtttccgactccatttttccgtaaatcagataatctaaagaaatattcaaacttgatgcaatgcttaacattgtctcaacagacattccgcatgttccacgctcaatatcctgacaatatttatatgcacgcccaattttctcggctagctcctcttgcgtccaaccaattagaatacgtcgattacggattcgttgacctacttcaatcctgttgtactttgtcaatcacttcaccaaactttccaaaatttaccaattttttgatttgacataattatatcgaacaaagatgttggcaacacctgttttaaaagtataataaaagtatgtcaccaatgtaaacttaactttatggtaaaattttgaaggtattgggagtgtatgatgattgttgtttgtgtcgggtggggatttgatcgtagttgtgagcattctgttgaagatataaaagaagttaaagaaattatagtaatcataagaaggggatatgttaaaaaacaggtcagaacagcggtttccgaaaaacagctgttctgaccttgacatataaattgaaacagtagttaaaaacaataatttttgaatcatttaattgcaattaaaagagactccatttatttgcaattaaaatttcgaaggactaagaaacatttttataaagcaccttccttatatgcaactaccccactgttttcagtaaaattttaatatccagtttaaaattccattcggttatgtattttttatccagtttaactacttcttcaaaattcgttatgctgcttcttccgctgacctgccataaaccagtcagtcctggcttgattgacaaccttgcccggtgatgtagttcgtatctttcccactcatctaatgtgggaggtcgggttccaacaaggctcatatcaccttttaatacgttccacatctgaggccattcatccagggaataattacgcataaagtttccgattcccttttcgcctcctatgatacgtggatcgtgatccatattaaacatcataccatcttttattcggttttgtgccagtagttctttttttcgcttctccgcattcatgtacatactgcggaatttatatattttaaatttttttccattcttaccgacacggacttgagaaaagagaatgggacctggagaatgaaaataaatacagggtgcaagaaccagatatagaaatccggctatgatgcagccaattaaaccgcctgcaatatccattgcccttttcatgaaaagctgtcttgaacttgccatgttaatgctggtggttaaaactgtataacctcccatgcgctctactctttgtttttgttcgtttaaaacagtgatatcaacgagattctggtggactgtaatacccatttccataaagttgtccacggtcttttcgagtgtaaaggaatctcttggcaggtttataaaaacttcatccacccatttatggcatacgtaatccaccacatgtttgatatcagagactaccggtattccttctatttcatctcctgtcatattggcatcttcaataacgattccgcttacctgaaaaccctcgtaattatagttgtttatattatccaatacagttgaagctatatctttgcttgtgatgaccagcagggaacgtttccctttattggttaatccggatttttttaagtgccttttccagaataatctgagaaaataggtggagaatgtatagaacaatccggtgagaatcaagatgatacgagaatattgttctcctgtttgtgttagaaaaaaacaaaaagcagtagatagaatcacaagacaggtgtgttttattgtttcaatgcattccctgtaatatcctctttttaagacgttcttaaagctttcaaggaaaaatgtaacgattatctggatcataaaaagaagaattgccatgctacgatagagaaaggttcggtacggcatgaaactttcttgtcggattaaatatgccagaataaatgatatttgaaggcataatgcatcaagaattatgaaatcaagatgctttatccaaccttcacttgctttttaatacatcaactctcacctcccctcatttaatcgttaatttagatttggcgttaataacaggttatattagtacgtttataacgtgacttaattataccctttatggggaaagtcaatgtttggatggtgattagtattgatttttataggattttagctggggtttgtaatggtagttttgcacgatggtttcaacaaaagttcaatagtttataagaatttttttgttaattgtaatatttaatagaataaaaattaaattagcataatggaatggattgataacaccttttgtaagtgtatatatctgactttttaaaattaattgtagattttgttctaaaattgttgggtttgatagtgggataatattaaatatactaaaatctgcgttggcctcaataaaagaattaattgtttagttaaactaattttattcattattaacaaaccgttagatttcacgtattattatatgatcctatattgttgaaaacagtgtgaaagatttttgagtttttaaaagaatataatttggtttttattattatgcaaacgaatgttgtgttattataattaatgttaacataactatatttcgcggtctatagtaggggtatgaagtatctatatttatcatttcaatagtagttaatgaagagtttaatattaaagatatgggcgagtataaggagatcgaaaattaattgttttgatttagagataaaaaagattattgatatgtaatatttttgtgataaaagtggacgtgatagaatatactcacgacataatatggatatgagataatatacatatgccataatttgaatgcagcataataagcatgcgtcataataggaatggatgagttcgaatgacttaactggaggttcatatttcatacccgaagaggatggacgaggaatgcggtaacaaaagtattttttgagcaaatgaagagggggagatgatgtgacttaacgagtggctggaaggtctgttcattgtttagagttagaaaaaatcaaaaactatttattgattaatagaaagttatatagatgatgagaactttgcttacaggaaatttaagaatatgcctttatagaaattatctcgctgcattgagataaagggataggttgatgaaaaagatatgacgattattgttgccagtgatgtcagattatgggcataaattgagttaaaaaataaattgaaagacagtttgaattttgattgcgagaataggagaccagctatgaaaagttaagtataaatatagcaggaagttttctttttgtatttatggtaaaaaggttaaccttaacaagtctcatgcatgggagctttttcaaaatcaatcaattatcagatttttctattgagattaaatttcactttatcagtgagcatcttatagatgactctgataagtttgctggcacagtgtccgagggcaatattatgtgttcgtcccttcgccaacttggcatcatgataagtcctgaaagtggagttgtttttacaacattatcatctgcattcaccagggcaaatcttaacacccttgagctgcgtttaggattctagtacgttttgcactgaaacttcctgattgatatacaaacgggtctaggccagtaaaaacgaggtaagtgtacaatttgacgcttaccttgatgcttataggcatactcagaaaatatcttaaagagaggaagtaatgaatagtactgaaataaaaaatatcgttacaaaaaagtatataatatgtgaaaatataaagatatgtaaagggaagatggctgattttttattgattacatcttaatagttatttttaaatagaacttttcctacatattaaaaaagttttcagtacaaataaatgctaaaagactatataaattctacataaaatcaaccttaatagcagaatcaacttaaaacatgcaccaaatagatgttataaacgtataatccttgcatttttacagaaagagagttaaaatatacacatcaatttattttgtaacaaaattgaaggtaggatagtgaaaggagaaacattatgaagatgaaaaagctaatggtagcagcattagccgcagcaatcactgttggcagtgcattaccagcgtctgcagcatggattcagtccggctccgactggagatatcagaatgaggatggcagctggcaggcaaacaagtggtatcaggaggatggcaagtggtatcattttgatgtcaatggcaatgcacagaagggctggtttaaggataccgatggcaagtggtatttctttgcatataatggaattatgcagacaggcctgctcaaagtcgatgacaaggtatattacatgaatgcggacggttccctgttttctggagctatgaagattggtggagttgaatataactttaccgaatacgggacaacaaacggaaagccatccgtaggtgcttctcagacttttggaggtaacgggaaccagactaacgtcgtcgttggcggtggtggttattcccgatcaggtggtggatctggaaatagtggaccaatcagcaacgttgtgaaagaaaacgtgcagaaagctgtagtggctgctgtagaagaaaataaggagaatgaattcgtttcgactacaatagcaggacaaaatattactgttacagttaaggctgagcaaaccgagtccacattaaaagaagtattaggcgatgctgaaagtgtattatcaggaattcttaccacagaaggtgtggaaagtgttcaatttggaaatacaactattactgttgatgacaacatcaaggataaaattaaggcagcagctataaaagaaggccttacccctgatacgttattaggtagtgttgaaaagacttacaaaataacagttgcattaagcgatggacaacagtcaatcgattatactttttcagttaaaaagtaaaaattgttttgatattatttctttttagggtggctctcacaggaaccgccctattttaaatatggagagcggcatgagagtaaaaaaaagatggataatttgtggaatagcatttatcataagtgcctgcgcagcccagacggcgtttgctgggtccattaatgggaacgagcagtctgtcatatccgcggtaagcggacaatttgagaaagacggaattatttatgcggtcaaaccggaatacattagctcggtaaaaagctatctggcccaggatgatgtggaattgactgcggaacaggctcaggcagctatttcagaaatatatgccaatgtacagaccggagtggaaagcggttatttagtagaggtaggaagaacctcctcttcggaaacagaaccttcacaagctccttcagaaggtcaagcggaacggcaggaaagcagtacatccacaaaaaaacctgagaagcaaaacacagaagaaaatcagaaggaaccagagactgcgggaacgcaggaaaacgaaggcccagaggctaaaccggaagacaattccgctacatcaaaagaaggtacgaaagaagatcgcataacagaaaagacctcatccgtaatatccatcctcgaacttgtagacaaggcgcctccccagacttatgaatacttatataaagatacagatgcacggatgcagcagtttaagatccggtacgaaatcatgtggggatgtttggcagcatctgcatttgcaattgcagcggtacttgctatatcaatacataagaagttattaatcagtcacagtcatcggaagctgcgcaaacttttgaaatatattctgacagctgccatagcagctctgtctttaacattatgcttaattggcggaggctggttcggagcatttcagaaaaatgcgattctcagtaaattagcggatacaggatattattcatttgcctataatgaactcaggaaggatacttccatctcattttcactgttaaatatcccgaacagcgtcatggaccaatctctcacctacgaaagggtggttatagcggccaggcagcaggtagaaaatgatttgaggcagggggctataaagccgatacttctgttttaatagaaccattaaaagccgatattgagaaatatttacaagggcagtctgtatctatgacaaaagaagcggaagcaggactttctcttctgatgggacgccttgatgaaaaatacacggctttactaaaatggccgtttgcctcgtggtggttacagttgaaggccgactatacaaagacggtaactcttcttctgcctgtctcattacttttaatcgcggcggcacagatcattcttgtttttctccatcattacaaataccggggcctgtcactgggagcaaaaggattaatgctgggaagtgcattgggctttttggtctttaccggaagcaatatggttatttcaggccggctgggagaaatcaaacctccttatatgaattcattttttgaaatttacaaaagcgggatatggaaggcaggagcggttgtttgcgggataggagtgctgttggcctgtatggttcttgctgctgtaaaagcatggaaagaaggcaaataacttggaacagatatatttttttgatatacactgccatttaatacctggggtagacgacggagcaaaggatataaaagaaagcctggctgcattaaaggaagagtacgatcaaaatgtcaggtggatcatttgtacccccatgtgacggcgaatttaacctctcagcaagcagaaaacataaatgcttcttttgatgatttaaaaggcaggttggaaaaaacagattttggaaaagagatggaactctatctgggttgtgagctcatgtattctgagagccttgcggagcggttggatgcaggggaaatatggacaatgtccgggacaagttatattctggttgagtttttgccctcagttgcttatgaggagttatatcgtgcggtcaggaaattgtctgcaaggggatatattccgattctggctcacattgagcgttatctatgcctgaataaaaggctggagcgaattcgggacctgcaggatttaggcgcatatttccaggtaaacgcttccagtttaaagggaggcgtgttaaaccagaaagcagcttttgtaaaaaaactatgcaaatccggtctgattcattttcttgctacagacagccacggcatggtatacaggcagccggatataaagaagggggccgaatgggtgatgcacaattgcgattcccggttaggacaaaagatattataccagaatggaattgcattgttgaatgatatcattatttaactgaggagaaagttatgggaaccaatcaggacgatgagattgaaatagatttaattgagttattttatgttttgagacggaaaatatggattattttattgaccggtattttgggagcagcttccttaggcttatttgcagcaatggttatggagcctgtttttacttcttctaccatgctctatatagttaataagactactacactgacttctctgacggatctgcagctgggaactcagcttacaaaggattacaaggtactggtgaccagcaggcctgttacgaaccaggtcatttcggatctggatttaaatatgtctcatgaacagcttgtgggtaagattaaggtggagaatccaacagataccagaattcttactatatcagtagaggattcagatccgtacatggccaaaagtattgcggatgaagtggcaaaagtggcatctgcccgaatggctcaaattatggattccgttccgccgaatattgtagaggaaggatatctgccgactgacaaaaccaggccaagtattacaaagagttcattactgggcggatttgcagggatgtttctgtccgcattaatcatactggtgttatttattatgaatgatacggttaaaactcccgaggatgtggaaaagtacctggggttgaatacactggctgctattccattgtttgaagaaaatgcttccatgcagaaaaaaagacgaaagaggaactttgggagaggaggtaaggtgcaatgagaaaggtttcattccgcagaaaagataaacttgattttaaagcaaacgaagcatttaaaacattgaggacaaatattcttttttcaggtaaggatattaaagtattgactcttaccagctctacccccaatgaaggaaaaacctccgtttcatttcagcttgccagctcctttgcagcggcggataatcgggtattgtttgtagatgctgatatcagaaaatcggttattgcaggccgatataaggtggatggaaatacatttgggctgacccattatatgacagggcagaaaaccatggaggatgtaatctgtcagacagacattaagaatatggatataattcttgcaggaccagtttctcccaaccctaccgaacttcttgggggacctttgtttgcaaagctgctggaagagcagcgggagaattacgactatattatcgtagatgcgccgccccttggaagcgtaatcgatgcagcccttattgcaagatatgtggatggtgcgattatagttgtggaaagcggtgtgatcagctacaaaatgctgcaaagggtgaaagaacagctggaaaagagtgagtgccgtattttgggtgtcgtgttaaataagatagatatggagcgagacgcttattacggaaactattacgggaaatattatggcaagtattacggaaactatggagaatgatattagtaaggatcaaaaagaacgtgtgcggtctgaatcaaaaggcctgcacacgttttttctttctttcttttatccaatctttcaaaattcacttgaccatgaccatacgtcaccctttataatacatatataataattcaggaaaaaggaggtgacaggccaatgaaccaatattatacctcaggccagttcgcaaaaaaagccaatgtttccatacgcaccgtgcggtactacgataaacagggactgttaaaaccatcgggaatgagcgagggaggataccggctatatacggattccgatttcgcaaagcttcagaaaattctctccttaaaatatctgggcttttccttagatgagatccgttccattaccatcaatgatgatgacaatgattacgttgaagagtctctccggcttcaattaaatctcatcaggaagaggattgagcacttaaagctggtggagcagacccttacggagacttcaaagctggtgacggaaaaccagtccgtggactggaataaaatcctccacttaatccatattaccaatatggaacggtcccttgtggagcaatataaggatgcagcaaatataagcatccggatcggtcttcataaaaagtatacaaagaattccatgggctggtttcagtggctgtacgacctgatggagcctttggatggaaaaagcattctggagctgggctgcggcaatggggaattgtggcgtgcaaataaggacaggataccggcggatgcaaggatctgcctgtctgacatttcagaagggatgatccgggatgtggaagaaagcctgaaaaatgttcccggttcctttacctttgaagtatttgactgccgtcagatccccaaggctgaggaaagctttcatgttgtggcagccaatcatctcctattttatcttacaaatttagatgaagcgctggaacaggtgaaaagagttctgaaaccgggaggcattttttactgcagcacctatggctcagatcatatgaaggagatcagccagctggtaaaggaattcgattccagaatcgctctttccgaagtgaatttatatgatgtgtttggccttgaaaatggagaggaaattttaaaagaccattttcattcagtggagagggaagactataaggattacttagaagtcagtgacccgggggcgcttatggaatacattctttcctgccatggcaaccagcaggagtatttaagcgaccgctacgaggaattccgggaatttctgaagaaaaaaatggaaaaaaagggttttatccatattacaaagcgtgctggggcatttatctgcagaaagtaaagaaaaattaatgaataaggacttgacagtgaccttacgtcaccctgtatgatgatatcacgaattaatacggaggaaaaacaaatgaagggaattattcttgccggaggctccggcaccagactttacccgctgaccatggtaacttccaaacagttactgcctatttatgacaagcccatgatctattatcccctgtccgttttaatgaatgcagggatccgggatatcctgatcatctccacgcctgatgatacgcccaggtttgaggctcttttaggagacggaagccagttcgggatcagcctgtcctatgcggtacagccttccccggatggccttgcccaggcatttatcattggagcggacttcatcggggatgacagcgtggctatgatccttggggacaatatttttgcaggccacggacttaacaagcgtctgttaaatgcggcaaacaaaaaggatggagcaaccgtattcggctattatgtggatgatccggagcgctttggcattgtggaatttgattctgacggaaaagcagtatccattgaagaaaagccggcaaaaccaaagagcaattactgtgtaacaggcctttacttctatgataataaggtcgtggagtatgcgaagaatttaaaaccatcggccagaggggaactggaaattacggatttaaaccgcatttatttagaggaaggaaagcttgatgtggagcttttgggacaaggctttacctggcttgatacgggaacccacgaatccctggtagacgccactaattttgtccgcaccatggagacacaccagcacaggaagattgcctgtctggaagaaatcgcttacttaaaccactggatcacaaaggaccagctcataaagagcattgagcctttgaaaaagaaccagtacggacaatatttaatggatgtccttgcaggaaaatacattgatagattgcacggttaaggtttgcccgcattaaaaatatgtcaataaaagcaggaggaagtataaatgaagattatcgttaccggaggagccggttttatcggcggaaatttcgtacatcatatggtgaataaatacccggattaccagatcattaatctggatcttttgacctacgcaggaaacttagagacattaaagcctgttgaaaataagcccaattatcggtttgtaaaaggagatattgcggacagaagctttatttttgacctttttgaaaaggaaaagccggatgtagtggtaaactttgcggcagagagccatgtggaccgctccattacggatcctgaaagcttcgtaaggaccaatgtaatggggaccaccacccttcttgatgcctgccgcacttacggaatcaggcgctatcatcaggtttccacagatgaagtatacggcgacctgcctttggaccgcccggacttattttttacagaggaaacgccgcttcatacgtctagcccatattcttcttcaaaggcaagcgcagatctttttgttctggcataccagaggacgtttggacttccggtaactatttccagatgctccaataattacggaccctatcattttccggaaaagctgattcctcttatcatcagccgcgctttggcagatgaagagcttccggtatacggaacaggggaaaatgtaagagactggctccacgtttccgaccattgcgaggccattgacttaatcatccacaagggaaaagaaggagaggtctacaatgtaggcggacataacgaacgcaccaacttagaagtggttcagaccattctcaaggcccttgataagccggagagcctgattaagtttgttacagaccgcccgggacatgacaggcgctatgccattgatccgaaaaagctggaaactgagcttggctggaagccccaatataactttgacacagggatccgtcagaccatccattggtatctggacaatgaggactggtggaagcatattatcaacggagaatatcagaattattttgataacatgtacggcagccgtttataaacttctgcggcatggtttccttaataaaagaaatggaacttccttggagaaaagaggcatctatgaaagtatttgttactggcgtaaaaggccagcttggatttgatgtagtaaatgaactgaaaaagcggggacatgaggccattggcgtggatattgatgagatggacattactgatgaggtcagcgtaaacagagtcattcgggcagcagctcctgatgcggtcatccactgtgcagcctatacggccgtagatgctgccgaagagaacgaagaactgtgccgtaacgtgaatgcaaagggaacggagtacattgcaaaggtatgccgggaactggatatccggatgatgtacatcagcacggattatgtattcgatggccagggaacccgtccatgggagcctgatgacgaaagggagccgttaaatgtttacggtcagacaaaatacgagggagagctggcagtggaggaaaacctcgccaagtattttattgtcaggatcgcctgggtgtttggtgtgaacggaaagaacttcataaagaccatgctgaatcttggaatgacccatgataaattaacggttgtagccgatcagatcggttcccctacctatacctatgaccttgcccgtcttctggtggatatgatcgaaacggaaaaatacggccgttaccatgcgaccaatgaaggcctttgcagctggtatgagtttgcatgtgaaatttttaaccaggctggcatgaatgttaaggtggagcctgtaggctcggatcagtacccggtaaaggcaaagcggcccatgaacagccgcatgagcaaggataaactggatgaaaacgggttcagccgcctgccttcctggcaggatgcgctgaagcggtatctgcgcgggtgatgagccgggcgaacatgcctgcatgttcattcggcgaccactgcggcaaacgagacaaaacgcgcaaagcgtgttttgtctcgtttggagattgtttctcccggcggatgatcggtaggagtggatatggaaatcaagataaatgactactgggaaccggatcatttccgggccttaagtgaggacaattacaatgtgtccagatcctgtgaatatgagaggaatgagatgcaccatatccattcctcaagcgaaatcctgtttgttgaacagggttctgcggaatactatgtctgcggtaaaaaatatcatctggaacagggtgatatcatggtgatcggaggacaggagcaccaccagaggaggcttttggagtgccccttcttaaggtacgggttgtcggtcaggccctcttattacgagagcctgaatcttggagaggatttgaaaaaggtgtttcttacgccaacggaacaggtgtataaggaacgttataagcatgtggatcctgatatcttttaccatattgtagaactgctgcaggagttgtatggggagcaggccgttcataaaccctttcgctccatgatcgaaaggaccctcattacccagatttctgtcctgttgttccgggtgttcggcctggaacggagagaaagcgagttgtccgtgatgaatttaaggatgatagacatcaaggaatatattgatgtacattttcgggaaaatctggatcttcagattttaagtgaacttttttatttgcatccggcaaccatcagcaaggagtttaacaagtattttggaaagaccctgataaagtatattaacagcgtcagggtatgtgaggctgccagcctgcttgagaataccaatgagagtgttacaagcatttcggcaaaatgcggatatgacagtgtcaatacatttttaaggcaatttaaggcaatcatggaaaccaccccactccagtaccgcaaggctgtgaaggaatggttcgaaaaaaaacgggaagaatttcaagggctgtaagcgattacagctctttttttgtctgaaagagggattctcatagaagatactccgaaaatgtaattaagaaatggtgatttatgactaaaatctatgcagaatatacaaggagaatgagatatgatgatagcagttaatacaacagactaaaaattaatggagggatcagttatgaagaaaagagttcttgcattgcttctttccaccgctatggcggcgtcaatgatggcaggctgcggcggaaagacccagaatgaaacaacagcggcaaaggagacggataaagctcagacaagcgctgcagaaaaaggaacagaaggagaaaaggtgctgctcaccatttttgacggttatgcgggagaagatccacacggaaagttcatttatcagtatgcggaagagtatatggcacaaaaccccaacgtggtcattgatgtgcaggctgtcagcacaaatgacatttacacaaagctttccgcaatggctgccactccaaaggatgtgcccaccattttcttcacatcggcagacgcagttgcgacccttcacgatctggggctgacagcggatatcaaggaacttgtgccggaagatttaaaagcgaaatttgccaacggcgttgtggactcctgtatgctgggagaggagatgtcctatttcccggttgcggttcagcctcaggcagtgatctaccgcacggacagatttaaggaggccggtttagaggctccaaagacatgggaagagtttgtggcggctgcaaagacccttacaaaggataccaacaatgacgggcagatggatgagtggggatttgatatggtaggttccaacaactcctccggacagagccgtttcatggcgtacttatggtcaaatggaattgattgtgtgaaggaagaaaacggcaagtggatcactgatatttccgaagatcagaaatttatggatgcattttcaagatggaccaacatgaatgcagagggcatcgttcctacggggatcacagaagtggattatcctacagctgccaattactttgccatgggatacaccagcatgttccttaccgggcccaatgctcttggtgtggcttatgccaacaaccctgatttaaagggaaagctgggatcctttaagatgcctggtgattatccgggaaccatgcttggaaccgaaggctatggtgtcagcgcctatgcaaccgatgcagaaaaggcggcagccattgactatctgaagttttttgtggagcatgacaaagacatgcagttctggcagagcagcggaaagattccggcaacagcagaaggacagaaggcagactatatatcaggagacgattatgcaggctttttacagcagattgcagacggctgccgtccgacagttaagtttgcaggtgtcagcggtttaaaaagcgctcttggaaatgcgtatgcatctgtattctccaatgaaaagacgaacgaagaagcagttaaaactcttgtaagcgatgttgatgagttgttagaggattataactgatcatgaaaatgagggaggaaccatcctccctcaaaaaattgagaagggagtaagatgaatttcatgaacaaaaatggaactgcccggataaaagtgaagtcccagaggcaaggatattactttactctgccgattgtcgtcatgctggctgcccttatcatttatcctatggtttatgggttctatatcagctttttcaacacgaacctggtgacgaaatggaattttgtaggctttaaatattatgcggcagcatttaaagaagcggccttttaccagtctgttctgcttacgactgtatttatgattctggtggtaggaggacatttcatcctgggatttatcctggccactctgctcaaccgggaatttagagggagaacggttttccgggtcatattcatgctcccctggtttttccctgaggctgtggtggctcttttgtttacctggatcatgaatcccatgtacgggatcttaaacagcgccttaaaagggcttggtcttatatccaccaatgtttcctggctgggaagcaaggagctggctttcccggcagtggtttttgtctgcatctggaagggctttcccctggtcatgaccatgatcctggcggggttacagagcatatccagggattattacgaggcggcggaaattgacggcgccagcaaatgggcccagttccggtatatcactgttccctccttaaagcccatcctgaccacggtcttgatcctggactgcgtctggtggtttaagcagtatactctggtttacacgatgacggcaggagggccgggaactgcaacgaatttaatcagtttaagcatctatggcacggcgtttaatgatttaagatttggaaaagcgtctgcctggggaatcctggtgttctttatatgctatttgatcagtctggtgagtaaggtggtgacaaaggacaatgagtagatcgaaaaagaaaaaaaacagtttgattgcaacttacgccgcattaattctcatggcttcttttatcgtggtcccggttttgtggatgatatccactgcctttaaaacagaaccgcagacgtattatcctcagcctaaatggctcccaaacccgttttccctggattctttccggaaatttttcagtacttataattttgggcgcatgaccttaaacagtctggtagtctgcctttctgccatggtgatctgtgtggcctgtgcctgcctggccggatacggggtgaccagattccggtttaaaggaagaaaacagctgatgagttttctgctcattacccagatgtttccgggagtcatgctggtggtgccgttttatgcagtactctctaagtatcatcttgtcaactccctgcttggcctggtcattgtatatgcagccacaaatatcgccttcagcacctggatgatcgtatcttattttaagaccattcccctggagcttgacgaggcggcgcgggtggatggagcttccagcttccgcatcttctggaatattatccttcccctgatcgttcccggaatagcagcggtagccatgttcgtgctgtttaacggctggaatgaatatatgttttcttctgtcctggtatccaaggacgaattaaaaacgctcactgttgggatcatttccttaaattcccaatatcagattaagtggaatgacttaatggcagcatccagcatatccagtcttcctttggtaattctttttgtaagcttccagaagtattttattgctggaatgaccggaggagctgtaaagagctgatttgcagagaatatgacttatggaggtaataaaaatggatcatataaaaatccatgacatcaaagtgtttgtaacggccccaagaaacatcaatctggttgtggtgaaggtagaaacaacggagccggaattatacggctatggctgcgctacatttacatggaggcacaaggcggttgtgactgccattgaagaatacttacgcccaatgctcaaagggaagcctgtggatgacattgaaggaatctggcagtcgatggcgggaagttcttactggaggaacggaccggtcttaaataacgccatatccggtgttgacgaggcattgtgggacatcaagggaaaaagggcaggaatgccgctttacagcctgcttggcggaaaatgccgggaagggatcgctgtctacaggcatgcggatggaagctccatagaagaggtggaagaatgcatccacgggtatatggacgaggggtaccgctatatcagatgccatatgggtacctatggcggaaacttcgacggaaagatacagaggatcgtaaagccccacaatgcaccggagggagcgtatttccatccgagaatgtacatgcaaagtgtatataagctgtttgaccgtgtccgcagggacattggctgggaagtggagctgatgcatgatgtccacgagcgcttaagctttgcagagactctggagtttgcccgggaaatggaacagtacaagctgttttttctggaggattctcttgcgccggagcatgtggaattttttaagattctgcggcaccatactatcctgcctctggccatgggagaactgtttaccaatcccaatgaatggaaggccattgtacaaaaccagtggatcgattatatgagagtccatttaagcgacatcggagggttgacccctgccaggaagctggcgcatttttgtgaggcttatggagtgaagaccgcctggcatgggccaaatgacttatctcctattggaatggcggtgcagatgcacctggatttaaacagccataatttcggcatacaggaattttccggcttcagtaaagaggagcaggagatatttccgggctgtcctgcaatcagggaaggatatgcctatgtaaacgataaaccgggaatcggagtctgttttgatgaaaaagcggcagaaaaatatcctgcagtggatatggatcacggctggctgttctcacggcttcccgatggaacgcccgtaaggccataacaaaaaaatacagaatacatataataatggaagcatttccggccggagcaggtcaaaaaatcccttatatcctcccggccggacttgcattttatctgctttcatgatataatggcgaaataccgtaaataccatagtttttcataaaaaaagattgacgaatcctggcctgtgtgttatagtaattgggcgaatggaagagcttaggtcttttttttatgctcaaaattgcttgcagcagagaaaaggacttaaaacacaacaatgaaaatttaagtggaggtggaagtcgtgcgcacaaaaatcacactggcatgtactgaatgcaaacagcgtaattacaacatgaccaaggataagaagactcatccggacagaatggaaacaaagaagtattgcagattctgtaagagccatacgatgcacaaggaaacaaagtaatcagttgtaaaggacgtgaaggttgaaagaaagacgtcttccaaccttgaatttgtgaagcgactggatatgcaagcatatccgcttacttcattaggaggcaaattatgggagatacagtgaacaacgagagtgctcagaagaagaacttttttaagggtctgaaaactgagtttgcgaaaattgtttggcctgacaaagaaaccgtaacgaagcagacgatcgctgttatgtcatcagcgattgctttaggattgattattgcgattattgatctgatcatcaagtttggtctcagttttgtcttataattcgtaagggttaaggtgagtttatgtcagaagctaattggtatgtagtccatacctattcaggttatgagaacaaagtaaaagttgacattgagaaaacaatcgaaaacagaaacttgcaggatcagattctggaagtatcggttccgttagaatccgtcattgaactgaaaaatggcgttgagaagaaggccgataaaaagatgtttcccggctacgtactgattcacatggtcatgaatgacgacacatggtatgtggtacgtaacacccgtggagtgacaggctttgtaggtcctggatcaaaaccagttcctctgacagaagaagagatggagaaacttgggttcaagaacgaagagatcatcgttggctttgaagagggagataccgttgtggtaacttccggtgcatggaaggataccgttggtgctatcaagtccatcaacgaaggtaagaaaaccatcaccatgagcgttgagatgttcggccgggagactccggtggaattaaatttcagcgaagtgaaaaagatgtaacaagtaaaagcggcttataccggtgtataggctcgtgggagggaaatccccgacaataccacatttatttaggaggtgcctaattatggcaaagaaagtaacgggatatatcaaattgcagattccagcaggaaaggctacaccagctcctcctgtaggtccggcacttggacagcatggtgtaaacatcgtacagtttacaaaggaatttaacgcaagaacagctgaccagggagatttaatcattccagttgttatcactgtttacgctgacagaagctttagcttcataaccaagactccgccggctgctgtattacttaagaaggcctgcaagatcaaatccggatctgcagttccgaacaagacaaaggttgctacaattactaaggctgaattacagaaaatcgctgagctgaagatgccagacttaaatgcagcatccgttgaatcagctatgagcatgattgccggtaccgcaagaagtatgggtatcacagttgtagaggcataattttcttaaagaaagcaggcggaagcgctgcctaaatttagaaaatcagcggttcggtgagccggcaggcgaatcggacttccttaataatattgcagttgatgtagttttaagaacgtgggagggaaaatccccgacaataccactaggaggttatttagaatgaaaagaggaaaaagatacgcagaggcagctaaaacagtagatcgttctgttctctacgatgcaccagcagcaatctctttagttaagcagaatgcaagtgctaaatttgatgaaaccattgaagctcatatcagaaccggttgtgacggacgtcacgctgaccagcagatccgtggtgcggttgtacttccccacggtacaggtaagactgttcgtattttagttttcgctaaaggcccgaaggctgatgaagcacaggctgcaggcgcagattatgttggagctgaggaactgattccgaagatccagaacgaaggctggctggattttgatgtagttgttgctacaccagatatgatgggtgttgttggacgtctgggacgtgtcctgggaccaaagggcttaatgccaaacccaaaagctggtactgttactatggatgtaacaaaagcaatcaacgatatcaaagctggtaaggttgagtacagacttgataagacaaatattatccacgtgccagttggaaaagcttctttcgcagaagaacagttagcggacaacttccagacgcttgttgatgcaatcatcaaagcaagaccaagtacagttaagggtgcttacttaaagagtgttacactggcttccaccatgggacctggtgtaaagctgaacgtagcaaagttaatgaactaattttgttttgtgattgacattgattataaataatgttataatatttcagtattaactgccgaagacagcaggtgccgtgaggcataaggtgtaaacgcctgccgaggaatgtacaagaatcattttatgtaaatgaattgtagacctctctgtccatccggcggagaggtttttctttgcggtttatacgagcgggcttcccaggcaaccgggaggttcagactaaacaggaggtaaaccataatggcaaaagttgaattaaaacagccagttgtaagcgagatcaaggaattactcgacggcgctgagtcagcggtagttgtagattaccgtggtatcacagttgctcaggatacagcgcttcgtaagaaattaagagaggccggtgtttcctacaaggtatataagaataccatgatccgttttgcagctcagggtaccgcatttgaagctctggatccaaatctggagggacctacagcaatcgctgtatccaagacagatgcaacagctccggcaagaatcctggctgaatttgctaagacagctccggctctggaaatcaagggcggcgttgtagaaggcacttactatgatgcaaagggtatggagaagatctccagcattccttccagagagatccttcttggaaagttgcttggaagcatgcagtctcctatcacaaacattgcccgcgttctcaagcagattgcagatgctcagggcggagaagcggcagaggcataattttcttaataaaagcaggcaaagacccgcttgagattagaaaatcagccgttcgaggagccaaaggtgattcgaactttctaaaaataaacatattaaatacggaggtatattatcatggcaaagttaacaacagctgaatttatcgaagctatcaaagaattatctgtattagaattaaacgaattagtaaaggcatgtgaggaagaattcggtgtatccgcagcagcaggcgtagtagttgcagcaggtcctgcagcagtagaagaagagaagacagaattcgacgttgaattaaccgaagttggtccaaacaaggttaaggttatcaaggttgttcgtgaagctaccggcttaggcttaaaggaagctaaagacgtagttgacggtgctccaaaggtagtaaaggctggcgcttccaaggaagaggctgagcagatcaaggcttccttagaggctgaaggcgcaaaagttactttaaagtaattatacttttgggttgttttggacaggatttgtacctcttaaaaagggacaggatcctgtcctttctttgtgtaagataacagaatagtcttgacaattttgtaaatttaggttagaatgtaggtgtattatcgaatggagttatgatttcacatatttttgtaagtcattattttcggatgatgatttacaaaaatatgtgattttttgtttcaggcgatatatcaaatattttttattttataggaggtacacgttatgaacaacggtacagtaaaatggtttaatggtgctaaaggatatggtttcatcgtaaatgacgcaacaggcgaggaagttttcgtacatttctccggcatcgtttctgatggttacaagactcttgaagaaggccagaaagtaacctatgatacaacagaaggaaaccgcggtctgcaggcagttaacgtttgcatggcttaataaaagcttcgatttatatgtaagctttaagggctgctctcattttagaatgagggcagtccttttcttttctacctgggaaaatataatctgccccgtttttttattttggaaggttattttaggatctttttaaaggcttgttgttttgaatttcttaggtgttgagaggtgctttaaaacgcgtctgtacgtgtcatatgtgtgggaatagagtgaagacaggatgaaggcaggaggcagagtacaggtacgctcggggaggtgtgtggtggctggaagatggagggataaatccctgttatttgatttacgacaaggtctgggctgcgctataagtccgggttatttataaaaggtcatgttctgttgatatggcgcaataagattgtgtataaaattctctttggtatagtggatatgtcctgattctaggggcatttaagggaaaagatagaaaaagacagaaatgttttggttttatttttccgtaaatctccatagattgattaataatggcagaaagctggactaatgggattatgaaaataaaatggaaagcagcctgtttactggttgtttttatactggatatcatttttgtgaaagcaatgcatcagtcgtacacggatgcaaagaataccctgtttcttcctgcaggagcggacgatgaagcagttgatgaggtcaggaggcagttttccggagataagcagatagcgctgacctttgatgatggccctcattctgtttatacgccgaggcttcttgacgggctccgcaaaagggggtccatgccacattttttcttcttggtgaaaatgtggaagggaaagaggccatcgtgaagcagatggaagaggatggacatctagttggaaaccatggatattctcatgttcagatgagcaaggagtcggtaggaactgcctgccagcagattgaacagaataaccagcagatagaagagattaccggagtgagacctcagtatttgcgtccgccttatggctcatggacggaggaattggagtgtaccaccaatatgacggtggtgctctggaacttagatcctcttgactggaaatcaaagaataccaaaaaggtggtacgatatattgtaaaacatgtagagcctggagacatcatccttctccacgatgtgtatccgacttcagtggaggcagccctggaggtgatcgatactttgacgaagcagggatatacctttgttaccgttgatgagctgctggtggattaagaggaataagctatagagttcgtggtttgtgaaacctttggggttgtatgattttttggaagctgagctaattgaggctttgaatattaagggggtcggttggccggcgattttttcatgaggattctatatgcttttcagaaagtttcgggaaagggatagaaggtggaatcataagagtgggtattgccagggtattttttgctttttaactttatgtttgatttgggatgatttgtatttgcggaataagtatatattgttggtatcatatagtttatctgagcttgcaaagcaggtgaggataaaagggtcgtactttgccctgcccccctgattataaaaacatctttttgatttcataatgtagcttatccgaacatgaaaagtaagtaaggataaaaggggatctctttgcacccgtgcatttgattctgaaaacctccttttttcataatataactatcctaactagcagagtaagtgagaataaatggggagttttttgccctgtggattcgattctgaaaacaagaagatgttttcagaatatagcttttacatattcttaatgagcatgttgattttctgtgcagtttgttgtatactgtgcttataggtcgaaagctccctgcgcggcatacagttgtcggtgcaataaataagcagtttggttaaattcttttactgtttgatgtgatgaatggttagacggttctttgcattgtgggaagtttttttctaaataaggtgtccaatggatagatccggatttataagggaggactcgcattagcatgattggagaactggaaggttatttgttctttctggtggttcatgaaaatccttatattctgttgggaaaaagacctggctaaattctttttcaatttgtgtggtatacagttgtatttattaagcgcattctgcggtaatcatttgatctttcaggtcgtcatcgacaaaaattccttcttaaaatattgttgggtttatgtgagattatactttatatgagagtgtaatggcgtcatagtttatttttgataattctatttttattttctatgtctttacgaaattagttctgaaaggaacaaatgccttgttgccattgaagagtattggaaggattttcctatttctatattttctcaatttatttttaatatgttatcttttgatttgtatttctgatttctaattcatatctccatattccatttttgctttacctttttatctgtgcattaagtgtcttatgctatagcgtttacagggtgataataaaagattttataagagttttccttagttttttgagataaggttaatagtagtttaatgagtttctgaacttgttaatttaatattaatattattattatttttagaaagacatctttttaataataagaaccagatgttgaaaatagaattcctatatcccgtagggtatgatactgattgaaaaacattgtgttgttgtgttttttaaaaggaacgtgttttcaagtatcaatttgagtaaatcagcttttttattggaattaaattgctgatatgtgaaaatgatttgatataacaattaatttatttggatatctggaataatgttgtagcagattattgtttatataacaaatattgaagttttgatttattaaaaaggtatatactttaacatattaagaatacctgtcattctgggaaatacacaatcgagtattccctctttaggttatttattccgccgttttttttccataattattatttataagtttgaaacaaaatggtcataaagcttttctccaggagactactttttttaagagagttattatgcactttcttactctagcagccgcaaatactactgtgcattgatctgcaatgtttagtacaaaaatttccttgcgattgaaagttgttaagttagtatttgagggttttattaaagaaaaagagttggtttaaccagagaaaaaataaataaaaggagtgataaaagtttgcaatgaataaaagaaaatgttttgttctattgagcacagtcctggcggcaataagtaccccgatgccgagttacggggcatgggtacaaaaggaaagttattggttgtatgaagaagaccagacctttgaaaggaatgcctggaagctgattaatgaggcatggtattactttgatgatactggttatatggccactggctggcaaatgattgaaggaagatggtattttcttaatacatcatcggatgagtcaaagggaaagatgctcaccggctggcaatggattgacgggcgttgttattatctggctgatgaacctggagctaatcatcctgagggagctatgtacctaagcgaaaggactccggatgggtattttgtagatgcctccggagcatggatcgatgacaacggtacgatacagtatgtggctggaaaaggggtacagacagtatttgtcaaaagatcagcatcggcaaataaaatttcaggaggcagttcaggaggaggcagttcaggaggaggcggatctggaggaaaggggagtagtttcaggccggggaatggatcgcagaattcagagattgatgaacaggagccggaaattaatcaggaaatttcggaaccgggagaaaacccggaggatatgaaggaaccagatgcggaagaaaagcagtataggtacacggtgcgatatatggatattattgataagacaatactacataccgtaactggtgtggcaaccgaagggagaacgatcattatcattcaaccggtcattaatgggtatcatctgtgtaagggacagagagaaagctttaaactgactggcgattctatgaacctgaacatctactatgagaaggaaatcccggcctctccctcagaggctcagaaagttgactggaatctctgctttgtagagaagggaaatcacagcaatgagatatttaggtctcaaaagggacagacggaggagggaagacagcttgttattgactttccggaatctattttaggcggcgacggttattattatcattctatggtttcaagtccatggagtattattgtaaacggaaatggtagacagaaatattatattgaattcgagaaaggagaccatcttccggaggaacgagacccggatcaggagaacaaagacaagctgaaaaggtggttgggggttgcaaaagaaacagattttagacttggtggcagggagccatcagaccagcagatcattactaaaagtatagaggaaagcaatgaaagacttcttaacctggtatcaatggcagacggtgtggagcggaaggagttttatctcattgcaaaggggcatgtgccaagtaccgtgattataagccagacatttcagaacattaagaatctgtctgaactgattgtggatgagtttaccatagcttatgagaaatacacgattatgagagtgggatttgaaaaaacttatgaagaaagcatttgtaaccacaattatcaggttatggataaagttaatgcctcatgtatgataaacggtcatgaaacgatccggtgccgaaaatgcggaaaggaagaaaccgtgatattgccagcgaccggacatgtggatgcggatcatgacggatcttgtgatgtttgttacaacacggccaacgaaacgccggaagccgtgcaataccgcattggagatgtgcaggcccggaccattggaaataagatttatctgttccgctgtattgatgatgattatgaagataccatgggtaacagccagcgaatggcgctgttcctttgtgacaatgtgataaggtcggatattgacgggacatcaatgaagcttaactttggatttaataataattataagtactccaatatccgggaatggcttctggatcatgcggcagatgattttctccatgaaacttatattggaattaccgggtcatacataggcgcgacatggaaaggggcgtatgagcagataaatgataacagcctgatggctgggaaagaagtgttccagcttttgcaggacagggtatttattttgtccgtggatgaggctcttaaataccgggatgtgctctggaagttcaacgggagcaaaaccaataatccggaatcacaagtttctgcttactctaaaggatattatcttcgcaccccacaggatggtggattggatgaattcctttatggagatgggatctatgcggtcagcctggtagatggcaacattcagccggttaacgtgaaagagacaggttttggtatcaggccggctatggcgattgcacaaggttagggggattttatgaagattattattttattcggtatcactgttttagtattatccggtttatctttggccgtgtttttgcggtaaattcgaaacagaaggaatgggaggatagagagcggcaggattagctgagaaaatactagagaacaaagtgtaaaggatgaaaaggctgcttcatctgaggttacaccttattaagcagattcaacgtttttcgaagcaaagagaaattttgaaagaatggagccatgaaagattttgaaatattaccggaaaacatcctattcggacaggaacttctggaagtttgaattcatttatctggatggcgaatgctatgatttgactcattctgcttataagcgttttccacccacagaatcaagatggtccggtttatcttataaagtatgggaggatataaaggcgatggaaggatatagaaaaggtgcttaccggctggcagtttactgataataggcggtactactttaccttgcagaatggagaccagaccaattttgtaagtagatccagcaaagctagagaaaccatatggtttcatatacccagatgaaagaacttttgatgggcctctggtatataaaaatggagcttgctccgatagggatggaacaatgagcaaagggatggtatgcatgttatgtacctctctggtaataagcgcagcgtttttcagaggcagtatgcattttaagtagcagaaaacgaataaaacaccaaatgggctgattaggcctttgtatttgaggcgtgccaaaacacagagataaaggaggaacaatgagaaaaggaattacaaaagggctggcatacgctatgtgtacagccttggtaataacagcggtgccaacctgggttgcttatgcagagaatgggcagaccataaaaaaagcagttcagacatccaccccctccaaagcggaccgggatacagaagtcaatcaggaggtggaggaaaagaacaacaacggagaattggaaaccggtttagaacaggaggaacatttaaaggaggccaccccttccgaggcgaaagaggtgccaaaggaacctccggaaatggtcattcctgcagctaaaatggcggtaacagccgcctccagctctctgggagatatttgggatgcttgggcaggaaaaaccagctttgagtttttaagcggaatccagggagaggggacggaagaaaagccctatctgatcaagaatcgggaacagctcatgggcctttcggagctggcagccatgggaatgatggtcccggaagctgggggaacgatgtatgccggtgactattccggatgctactttgcccttggcggaaacattgatttacagggagtggactggattcccatcggcttttaccgggattcctcggaaagcattggtgcggtcccctatcccttcagtggccagtttgacggaaaaggctattctattaagaacttaaagcttacatcctttgccaattataacaatgtgggacttttcggggtggttacggatgcagaaattcatgacgtaaccattatcccggatagcagcgaaattaagggaaaggaccgaaccggagttgtgacaggatatgcggaagattcccggatccggaacgttaccgtgaaaaacgcctacatccgttccaccggcattgccgggggattgccggggaaatcagcggaactgtcattgaaaatgctacctgtgaaaaggtgatgattgatgccgccggcggaacggatgtgatctatgccggaggaatcgccgggatcgcatctgattcctatatcgtagactctgatgtttccaccggagacggaaccacggccagaattcaaggaaccggctatattggcggaatcgtaggataccagaatgcagcctatatttacaatactcgtgtcagcggaaccattggcggctaccattcaacggccatcggaggtatcaccggaagatatgcagcggggaaaataaaggtggcacggtttgagggtaccattggtaactcccagcttgggtccttagcgagggaagggaccttcatcggaaccagacagggagctgcaacaaactttaattacattgaagatgtagcctatttatttgcggattctgagagtaagatcagtgccaatgtgtgcggatcggaaatacctgatgataatgactacacctatgctgcccatgtaggctactggcataccggggatttatattacaccctggtacagggcggagcgaaaaagtccatctcagaccggtatttctatgaggagttagaagatggcatcctgacggtcgtggacgaggaaagcggggattacacccttgaccatttcgcccccaatttcctgggccgcccggtaagaggatatttactaaatgtgaaccagatcgacacgatagcaaatggccagaacttttatgatgttgccaccctggaggtaaggggaaactcccagtactccaaaccgcttaataaggaacaccgtggagctattgcagccggtacaacggtaagcgtaacaacagccccgaaaaatacggatacagaaaagttccagatggaaggaacgccaacctataccaacggaaaaggggtaaagaaaagtacaacctattcagatgggagccatgcctacacctttaccatgccgcaagaagatatcactgtatcagcggtctataaaaaggtggctgtatccatcaaggtagagccggaaaactatacctttgcagtgacccagaccaggaccggaaaccgaaaaaatccgataaagattacggagatccgggataaagaagggaagctccttgcacgttttattaatggggtgttagagcagggaaccgaagtgcagccggtgaacatcaaagctaccattgatgccaataatgatgtggtggatggccgggtgaagtggagcattgatgatccacagctgatcagtcttgcaaagaatgatgatgaggaaactgatggctatacagcaaaatccgccagcctttctgtaaatctctcctcctctttttttacaagcatcatagaagaggcagaaagagtacaggcggaggggaactaccagtataaaattcccaatacgatttatggagctgggcatcaaaacggcggcgttgcggtcctgacagctcagaccaggccctctgcttcttttgaaggaaaaccctgtacggcaaacagccgggtcaatgttacgttccagatcctggacaataccctggtagcaacagaaggggcggtccttgataaacaggccattaaccttaccataacaagaaaattaaccggtgaccggatcaatccgcaggaaacggtaacagtaacggttcctcagtcattaacagccaccttttcaccggactttttctcaagggatgaggtaacctggacaagttcggatccggcagtggttttcgtatcccaggatcaagaaggttaccgggaagcattagtttcagccttaaaggattcagcatggatcaggaatatcatggcaaccgacaacggaatccgggagaatgataagtatgcaaagatatccggagccggaagccgggatgtgattattacggtaaatggaaaggataaattgggaaatcaggcttcggcctcatgtcaggtaacagtaaaatttgttaccaatgatcatactcgtattattccagaaggaatcaccctggataaaacgacactcatttacagtcttggttatcagaaggccggggatattcattctgaaaccgttaaaaagactggctttgaaacaaagaaactatctgcagccgtttttcctgaggtggaggataccctagatcataggccctatgaccgcaacgttatctggacctcttccgatccggaagcggtaagggtggatcaggaaggaaatataacttcggttgatggggcagcctggatcaaagaagcacttttaatggcaccataccgggcagaaaaaaacgtggagatcacagctacaacaaaagatagccagaaagccgcttcctgtaaggtgacattaactttccaggcagattgtattgaggcagaccgtgagagcgaaaactttgaccttgtgcttacaaaaacaggaaagaggaataatccagtcctcacttggaatgggattgaaggtaagaaatttaatgcttccatttactcaggaagccaggagaataagaatgttttatggcgttcctctgatgccggaatacttacggtggatcaggaaggaaatgtgatcccggtagtactaaatgagaaacaggaggttatagccagctggatcaaggaggccatggcaaagactccatacatcggaaccacaacagatacgatttacgcagtttccagtgatgagaaaatgtctgatccggtgacggtaactcttaattttaaagtaatagataacaccacttccagcagttcttccggaggcggaggcggtaaaggttcttctggtggtggaggcggttcccgttccatgggagtgacaaccgcagggaacacccaaggaccggcagctccagctggagccgtgacaggaacctggatgcagacagcaaatgggaaatggatctttgcctcagagcggacgtacacagatgaatgggcctatatcagcaatccatatgcaacaggagatcaggaaagagcctcctggttccggtttgataaagatggatttatggtatcggggtggtacacggatgcagacggaaatatttattacttaaaagccgcttctgatggaacccagggacagatgcttaccgggtggcaatacatatccggtgaatcagggtatgctgcagaaggagtctggtattattttaattcggtttctgatggaacgagagggaaacttctaatcaatgctgttactccagatggttttatggtaaatgagaaggggcaatggatacagtaaaacactttgaaaacatatctcctctgcttttttagcaggggagaagaggaggaaaatatgaatcgtgtgatattaatggggagattaacccgtgatccagaagtaagatattcccagggagagcgtagtatggcaattgcaagatatactcttgcagttgaccgtataggccgcaggaatcaggagggcaatgaacaaacggcggattttatcaattgtgttgcatttgataaagcgggagagtttgcagaaaagcacttttgtcagggtatgagagtactgatttccggaagaatcctgactgggagttatacgaacaaggaaaacgtaaggatttatacaacggatatcgttattgaaacacaggaatttgctgatagcaagaaagcatcttctgataattccaggcaagaaccgtctggtgcggcaggggacgagtttatgaactctcctgatggagtgggtaatgaagaacttccatttaacagttaaggcggttacatagcatatacttcgtagcaagcaggacattgacaatcgaatatgttaaaccgatataataatataaagaggataggttagatgaagatacacctatctatctcttacttatgaatttaatgatatttgcagttattgtatgactttgatactgaaaaaataaaagttataccggactaatcgaagagaagatgataaaaggaattgcttcatttatttcctcaatctgaaaggtacatcgattaatggagagaataactataacgacggaagtatttatgaaacgtacctatataatataggtttccaggtagacaatgctatgtttaaggatcgctgttaatatttttcgaaatgcactcgtgagagcaaactttgttgaatataggaatggaatcactgaaataagccaatatcttgaaaatttctataaaagcctgctttcagggagagaaattcgcttagaaatcctggccttgttatgaagaaacattttgtaccaaggagagaggaatagagttataagtaaaaattgtaaagattaccatgatatggtattattatcatggtagtcaatctgccgggtggtttccatctccgaaaggaggtggtgattgtgaacacttatgaggaatttatggtaatcataaatgttgcagtgttaatcgttgcaatacttacatacgtgaaacgcaatgacaaaggtacaaaaaaataatcacccagccgaccaaagcattggtgattatttttaaatgattaatcaataatttggaagccactctgtggagttggctaccctttgtacctttagaatagcacgaatttatgatgttgtcaaatcggagatttatataatagactttaagggaggatttaagtatgaaaaagaagttattgacggctgtgatgacagctatttttataattggatcagcaacaacttcatttgccggccagtggatccaggatggaagcaactggaaataccggaatgacaatggcagctacgcagctaactggcaatggattgatgggaagtcctattattttgaccagaatggcaatatgctcactaatacaaccaccccggatggctacacggtgaatgcagatggggtatgggttgaaaatggaatagaacagacaaaaaatgccaatgcatcaacaaaggctagtacagggagctatgatccacagtatcccttaaaaggctatatggaaccatggtttgtgaccagcccggttactggtactactgcttggaaaagtgatccgaataactttttctatgagtccaataatcatttgcagtatgctttggatcttgccacccaaaatagagatcctctttctctcaattattttgcaggaagggaattggctgctattgcgaaattaacgggatatccagctacaggcttggaaggtcacacatcggaagaagtagagagcctagctgcagaaattcggaactttttaaatagttttgattggagaaatgcaactgattatgaaaaagcagtacggattgctaagagaatcgcacaggcggactacttgtcccaagaaggaactcagtattcttatagctgcttgatagatggaaaagcaaattgcgatggatatactgatgcagcttatttactatcagcatgtgttggattgcctgtaagtggacttagttcaggaaatcatatttttcctgtgtttttggtggatggtgtgtggttagcttatgagccaacaataaaaaataattattttacagtagccgatgtgtataaaaaaaatatacttggaaattatcagcaacttggagaatactgtcaaggaactggctatgagattcccataagtgtggaaggaaagttccccaatatatcatatggaattattcagggagaacaagctccatttataaaatttaattaaatatttttatattttaacgaaaagctatcggttaatcataatcggtagcttttttctttgctcaaaacatttggagaaaatgaaaaataaggagaataaatgtttaaatataaaaattggaagaacattataagccgcataaaattaaaacagaaaattgctgcgttgcttgcgacagtcttattattgacacctatatttacctatcttcctccaggtgtctttaattcttggggattcggcttggtatttgttagttccggacaggctgggcacccatatttgatgggtaaagcgcctggtgacgatggaaataagtggttcttgtgcatgaaccaaggagcttcagcccatagcaattatgactattccaaagttaacatggatattgattacaatcaaggaagcattgaacagaaaagaatgttctgggcttatatcggtgcatttgggagttatgatggaaagacctctcttactactcagtttggcaggattgatagagatactgcaagagatgtcgcttggactaaaggaaaaagtaatggcggatcagaatggatagaaaacctggccaatgatggttttatgtcattagcaaacattccagaaggctgtaaaagcccaaaagatatccttaagttgattagtaaatataataccgctaacaaggccatgtacatcaacgaactaagaagcggacccggagaaatagatacgacaaagctgtatgagttaactggacttaccgattgggaaacctttaagaagtattgcaccattgacgttgtgacgccgggaatggttattaacacagagggacagaagcttttctggagctttcctagtattccggctggtcaaaaaccaaccgaagcagttatgaagattagttacgatcctaccttttttaatgtactagaagtaacaggccgtttggagtattttcagtgtaatgttccaagttcccagcagttataccgggctaaaggaaatgtagaggaaataaattgcgaattttacctcactacaaaatacagcccaaatacacctacgcccaccaagggcggtggagaggtgtccttaaagatctataaacataacgaaacctttgaagccaattataaagttgaactggaaaagagggattatgaaactggaaatccgctgcagggttctacctggcaggtattagagcgtttcgataatagtcagttaagtaataacgagtctggcggcggaatcatcgaagataacatgagagaagacccaacaacctggcaggattggctggtgtttgatgatgatctgataacaaatgtcagtggacgtatatctcataaagatacacgtttttatgattttagtcatgcctactgtaatggtcatccactccccccggaaccggaaattgatgaatcggaaagtggagagggtgaggaaggagaaggaagcaacgaagctgatgaaggggcagaagagtatgaacaattgatggaggaatggcaagcggccatagacgaatgcgaagcccgtgctgcagccagtggaggaaccttccatcactggttatgtaacagtgaggaagaaccatctgaagaagaggcatttgaagcatcaggctgtaaagctgccagggacgctgcatatgaaacctttatcaaccttgaatatgactacacgttccgggaaaccaagccaagagatggttacatcattcatgatccgggacatccggatgatgttccgattgagatcatcacaacggcagcttccgaagcagaaaaacctaaaaaatggaaaagttccagtaatgcagatataaaggtcaccggatatgtccggaacatgacgaagaatagttcggctgatacaggtattgagggatttgctggatcagccatgcggagtttgactaacagggaaattcctgaattagaggaatccagccagatagatgaaagtgatcttttattagctgataacagagataaggtagcaagtccttctacatacttgaaatcctctgaggaaagcggagatttaatcctgaaagaaacctatgatcttccactaggagaaagaatcataaacaaacttcttaagttcatcggacttcccaccgcttttgtggaagagaaggaaattaccgtaaagcttaccgctaaggataaaaaagaattatatgatgaggagtttgatgctgaagaagaggaattcccggatgaactcttagatgatgaagaggagtctactccatcgcaggccaaaaggaattctatgaaccgtttgttaagatatagcctggccacagactccgatgccgcccttcctaaagaagaaagaggaatcagacaaatcaaccttttggcagaagatactgacgaagagccagttatgacaacaatgcttggtttcagtactcttagcggagattccagtaaggggttcgaaaatggagaagaggacagtcaaccagaagtggataaaggaccaagcaacaatacagcccatacctttaaagtatacgatcatcgtgtaccaggacaggtccatttcaataagaaggacatggaattaaaggacggggagtttggaagatataattcctatggagatacccagggtgatgccactttagaaggtgctgtatatggcctgtttgcggctgatccaatttacggaccagacacccaacgggatgacaatggaaatgtgacctccggtatcggagtggtatttgatgccaatgatcttgttgctgtggcaaccacagataaaaatggagatggttccttcttaacagtaacagaaagacctcatagtatctacaattacaagatagggaaaattgaatataccgggaagagctatccagaaaacctatatgtaaaagaaggatatgaaaaggcgcagccacaggaagaaaggggccgcatctataaagataataagaccatgaatggggacagttggatcgggagacctttgattcttggcaattattatgtcaaagaactttcccgttccgagggatacgaactttccatcaccggaaaaaacctggaggttacaaatgcagaagagagtacccgtgagtcctatggtgataccgctgattcaaaaacggctcctgtgggatctgtctggatcacaaaacagctatatcatgcagttactttcccggaggggaatgctgcttatggaaataaggaaaacttgattcttcttgaaacaaaatctaaagatgccaccaatggttataatgtagtccttgatgggattccggagggggcaggcatctacttaaataacgtcacattaaatccggtggtgatccagcaagtggacggaggaaactgggcagatgcaaaggaagcgcctttttatctgacagcagaatccgattccgtttataagcgtgatatcaatggaaacatgattgagaagccaggagtttctgcaaccataaaggttccctatgaagctgtcggaactgaggcagataagcttcctacggaaggaacggctattgccagtgacccaacaagatttgccggcacctttacaaattcagacagtaacataaagtatgtgaaagccgaattagaacagatgatgcgcaatgctctccatatggagactccgaaagatggtaattattccacggtagatgttccagtctacgatgagaagcggactgtgaatggaaaaaccgtttatggcaagccggaaatggtccttgaaattgagaatgtcacaacgaatcagtcagtgatagaggcgattttaaattatttcatcaatgaaaaggtatttacctatggcggacttcaaaagatggaatacagtggcggaaaagttattgtaacggtcgttgtcggcatgacgccgggaaagactttgttgtatcagacaaattccagtggtgatgttgtggctgcttacttaacgaaactcaataccacctacggaagatatgtcattagaaagtataccggcagcgaattaaatgccgcagaagtagcaaacactggcaaatacattatcaacgttacgcctgattatgaagtgggcgatgatggaatcccaacggataaaaccatgtacccgacagacagtgagaggtatctccgttatgctgcaggggaaaccctttacgattactggtacttaaataacggaacttacgttggccatactcccgtaaccaggaaagtctggaagccaaattacaaggaagtcattgtaaacgaggagaatgtaagctcttctaaaatcacaaaggttaactccatggaagaagtggctgaccgggagggcagcacctattacttctatgatcaggaggcaaagcagtataccattcatgttggctcaaaggatatggaccttaccggaatcaaatcaggcaactttacaatcgcacttgataatggaaagaccattgtaacaaatggagatataaacaagattggttctaataatgtgtggggatatacggctggggccggcatatccaatgcggaatacgtaatacgtgtttccggagcaggagcaggagccggggcctttacttccttagattttgataccaacaagactttcataaagaatcagcgcctgatatgcaacggatatcatgatctgcttgaggacggaaatacaagggagacgccaattcttgtgcaggaacgcatcattggccagcagattaaagtaacaaaaaccattgatgaaagctcatatgacaacattaacttccatgcagaagcccatgatgactggtttaccaggacctttggagggcatcttggaagagacacggtggccaagaaaatggataacttccgctttaaggtgtatttaaaatcaaacctggaacgtctataccgtgacaacgaaggaaatgtaatctggcaggaccggatggggaatgaagtgaatgtgtttgagcaaaaggagagattcccagccctggtaaacaaggttttcacaaaagtgcagcatgttacctctcctttatacaaagattccggtgactcaatcgtaagcaacgattccttgtacagctataccaatggttttataaatgaaagccagaataacggctatactgacctgctggagaccatatcaataaaggcggatagcagtgcagaagcaagaatgatttctggttacaattatgacaagttctttgatgccataaacgtggctaataatgataaatgggatcatacagaaaactacagcacatcctttaagctctttgccttaataaagaagctcctttttggaacaaacggggcggagaaacagtatccatcagtccataataatccggatatcaaaaaccatattaatacatcggatatcgctgccaataatgcccttcgctctgataacgtccgccaatttgccattacctggtatctggatgacgaagcggcaaagctggttaaaaagaatcaagccggagaaacggaaagcgccacaggtggcaatgcttattccgatgaagtttacgacaaagccctgtcagaagctgtccgaaaggcgggaaactatttgaaacccttctttgcatatgaccttgaccggatttattctattgactgggacagtgcacaggacggtggctcagatcaggatctcacaacgctttcggcggataccttattcggtgccgtttccggaagcagtgatggctattattttgccgcatcaaaatacctgccatacggaacctatgtagtggcagagcaacagccgaaattcagcaatcttggggattttaagaacaagcattaccagattgataagccacgggaagtctctcttccgtctgtatatgcaaactatgacggttctcaggctacaccggaagtgactaataattactacaattattttgccggcataacacagcctgagatggagagtaagtacaagatccgttttaatgaagaagctatccatgtaatcaaaggcaggaatgcggatggtgactttgaagtttacaagtacggcatggacattgacaacattaaaaacggcgtgacgggaaccgggccgggtgattactttgccttgagccagagcgcattcaaaccgtatcagaactactacaatgaacaggacaacaggaccaatgaaaatgtcccatattacctgtcagaaggcttaagcggtagggaagccgtatcaaaatattaccgatacagctccgtggcagaaaacaaaggcacagcaaataatgttccattccctacggagagtgctggaatcgaatacaaggacaacgtaacggccatgcaaggcgtacaggttgcttatgatgggaaatatgcccctatgcttgtgccgtggacgactgtggcacctgacaatgcagttacagaggttgaggacagcgccctttccgcaaatggagagagttcatacaaaggttttgggtatacaaaattttacaacacgttctttaaaacaaagctgaggattgaaaagctggattcagaaaccggggaaaaccttctccatgacggagcgttatttaccctttatgcagcgtccagggaggacggagagtatacggatggcctggtgaagttttatgaaacagatacccgaatcgaaggatcaaaggaatttctggaagccatgggaaccaggaatatagccttggaagggaatgtctggaagggaactgttccggcaggaaccccggtatgtaaggaatcggaacaggtgattcttacggatcaggaaggccgaagaacgggccggtttgaagcctttacaaccaccagggacggccttcaggccaaggaagaggatttaacagaaacttcctatcaggatcaaaataccggatacctgattaccccacagccacttggagccggaacctatgtactttgtgaggtaaggccccaactggatacgtaagaacaaagccggtagccatagagatttattctgaccggaccacctattaccttgacggaaacagggataaccgggtagcagcggctatttacgaagataagacaggagaaggcccggaggagatcacaaacactgcaaggatctatataggaaatactccggttcgtctggaagtatccaaaattaaggatacggaaaatactgttacttacaagaccaataccagactggaaggaaccgaactggaattaaaacaaaagtatgggacggaaaacttggagtttgcctacaagaacggaacttatttaggttacgcctggtacaaaggcaccctggagtatttagagtccagaaagacctccggagaaaatgcagagccggtttacgtagacggcgtatttgctggttacggcctgatatccagaccattagacaccgcagacgataacacccgttacgtggcaggggcgcagatggctctttacgatgccatagagatcaaggaaaacggggacagcggtgattatggctatgacggggtaaaggtaacgagggaccggaataacaacgttcagtccattcaggtattaaagggatacgccgggacaagcattgaatttatccgggaggaagatgaggaaggaagcataaacggagatccaggggaaggaacctggacctaccgaacaatagagcggggagatacggatattctgttttattccctcggggaactgaaggtgacggaaaccagaacggatggaaagctttatggatatgaccgaaatgggaatcgggtacagataaaaaaccaagaatccatttatgtgctgaagtccgggcagcctgtctttgaactgaccggaggggatttaacagcggtgaaatattccgcagcggacaaatgctttaccttaagccatggaaccattctctatcaccttgacagcaacggaaaccgggatgcgtatgtaaatcccaccaccggcatggcctacgcaaaggaagggcaaaagctcctggtatggccggtaaaggtatccaaaaccaaaaccggagcagccattgccagggaaaaaatcaaaacctggagaattgcttccatcaatgcggatacggatcaggaatactttacagggacttatgacggaaagcgcttgaataaaagcatgaatcccgtcttaaatggccacggacttccggagtattaccaaagatcagcagaaacctataaaaagggcaatcccgtctatgacattgacggtgattacgtccgctataaatacgatgaccttctttccgcctacaacaatgctgcatacaagatcaataacaggaccggcatggaggatatcggggaagaagaggatactacagacgataagaaactttaccaccgccagggagaagcctggatcatggaaaacacctggatcaccggagagaagtaccccaatgatccgtttaaaaaggaaatgaccgtggggcaggccgatatgataaaacgggtgattccaggaacctacattctggaagaggtaaaagctccatccggttatgcaaaaggatttccggaaggcattactgttacggaaaccagggaagtacaaaagaccggaatggaagatgaaaagatcaaggtggagatcgtcaagaccgatgcaccgggccagtaccggataaacgtcatatccgatagtgcggggcacgctgtaagtgattatgaccaaggatcaggctctcaggaaaaccttactgttactgagccgaagggggcctacggttacggccaggtatccggggcgcatttagtactcttcaaggcaaatcggatttataccacagacagcgtgacctatccaaaaggatattatcttataaaggcagaaagcaaaccggcagaatggacagtagaaaattccgttgacaatgcaccggtacggatcgtggctgactggatcacagatgggaccccgaaatactttgagggaatccctgcaggggattatatcctggaagaggcagaagtaggcggcggctatgtccgcagttctatagagcttacggtgaaagcgaccggagaagtacagaccataaacttaaagaatgaccataccaagctggaggtctacaaatactacgtagacagcaccgggaaaaagaggcagcttccaaacagtcatgcagcaggtctggctctttacgaagcaaagacggacggtaatggaacaattgtaatggatgaaggaaagccggtctttgataagaacaaaaagataacagaatggatgaccgatgacttgactgagtacaccgaaaagtttgaaaaaagtactggatttatagaccgtataaaagaccttcttggcctgtcagaaaatcagtccagctttatcacagactttgaggcagcctaccaagagtacggggaaagtcttacctctctcacctggtacaccaaagacggggaacgggcggcagggcgcagcgagagccttcagaccggaaaaggagagggcgccgtccagatctggatcaccgatgccggaaaaacaatccggatcaccatttaccgaaatgtgaaaaatggctcccttgattcggacgggaaacttccactgaattttgaatatcagttcaactacaaagaggaaaacggggtaaaaagttatgacaccttagaaggcgtgcaccggattgattatcttcctctcaatgcagagaaagacgggaagaaggtgggaaattacgtcctggtggaagaaaagacaccagaaggctttgaaacagccgatcccaaagcagtagtccttgaagaatccggaagcgtgcagaggatcagcctggaaaataaagaaaaatacatcaacgtcttgaaggttgtaacagacggaacaaatgagtatgccgtggaaggtgcagaattggccctttatcgggccgatgaagccgggtactttgtagaagatgaaagccacctggttgaaacctggctgtccggatcggatggaagatatacggaaaatgatagatttaacggggatattcttaaaggactttctgtaggagatctaaagccacacaggattgataaaaccccgtacggaacctattatatcgcagagctaaatccaccggcttacatgcagaaaatagagccggtaaagatccttgtgggcgaagaaaaaatccctgtttaccgggtcgtaaataccccaacagtaggaaagctggaaattaaaaagaaagcttctgataccgggcaaggtctggaaaatgcccggtttaaagtgacaaacaaggataccggcgatgtctggtacatgacaacaagcgctgacggaacggcggaaattaccggacttcccgtgggcctggtgcagacagacggaaccataagaccatacacatatgccattgaagaaatttccccgccggattattaccagatctccgaaggaatgaagaaattccagtttgatgggaaagagagcggaagagaaatactttatacctgtgaaattgagaaccagccaacaaagatccaatttaaaaagacaaactttaataatggaatggctgtggaaggtgcggaaatcgctgtatatcatgcagtagccgttaatggggagtatcaaaaggatggagtagccattgaaactttggtttcaggaccggatggatttactttgacaaagaagctgtcagcaaactgggtatacatcatggaagagctaaaagctccacccggatttgccctttcaaagccggtgatctttactttaaataaaactggaaccggaatcaggcatgtttcaaacagcttcagtgtcttgaagctggctggtgaaaatgaccatatcgaagcccttaccgtaaccggaagggtcccagtaaaggtctacaccgttttaaaagatttagatatggggactgaacttcctccattgattggatcaggcaacagtcaggcgataacagcagaggacggtgttatagatggccacttatatgagattaacgaatacaccaggtactcagacggcaggacagaaaagtcttttaaggaaacaaaaaggatctattttgatgaagccgggtcttgcaccctttcttccagaacctatttggaagcccggcaggagctgaccaatgcagagggaaacgtccttgcaaactggactgtcaatgaggacaatcacaattacaccatcaagaatccggtaaccagggaagtttcaatcgccaaggtaacaggcagcgtgggtgtgggtcaaagtgcagtaaagacaggaagcgtcataaaatacacggtttcctataccaatccttacaactatccaacagatatccaggtcaaagcagtacttacagatgggcttgaatatttaaggtccacagattacggagcagaacaaaagggaattgtcacctggaaccttacggaaatcaccgctcatgaaagtggtacggtggatgtagtagctgtggtaaacggtgaagagggaacgcagacgaaggcgtattttgaaacaaagatagaagcagtaataaagcaaacgactctcacaaatcccgttgttccagcgggttccattaccatcataaataaactgactggtaccggaaaggatcaggcggatgaatttacccttcatgtaaggcttatagacgctgctggtaaaaccttaaccggataccaggcatacagcggttcatcagagggccggatcaagggagaaggaaatatcaccataaccggtgatggctttctgatctttgcagggcttccctacggaaccagctacgagatcatacagcagccaaaagacggatatgacagtacatcatacaccgggcagacggaagaaggaacgataacaggagaggtatcaaaaaatcctcagagcgcagtatttataaacaaccgaaacaatgaaacgatccgggaaatcttaacagcaggaggaaactaccagctcactgaaaccacaacatacagtgacggaaacagccttacaagcggaatataccgcttccagctaaatgcagacggaatggttgataatgtggatatggaggatcgtccgatacacttgtatttttcaaaagtggatgcagaaaccggagaagaacttgcgggaggcaaatacagccttatagatgaagaaaccggaacggtgatctatgagtttaccaaagagaaaggagagaagatggttatccccgcagaacttattatcccagggaagaaatactcagttaaggaagatatttcaccggaaggctacttctacgaaaacaagatttgctttacagcagaggagagcggcattccagaaaccatcattatgcaggataaaaagacagaggttgaaatcataaaaatggatgaggaaacgggagaacttttaaccggagggcgtttttctatccgggaaaaagaaactggtactgttattgagaccttaatcccagaaggaaaaccatatcttttaaagggaatattgactgccggtgccgtgtatgaactggtggaagaagagccacctgccggtttcgccctcagtcagagcatagatttcaccgtacctaaagagccagaatcaattaccattaccatgaaggataggaaaacagaagtagtgattaaaaaacttgctgggaatatgggtaagggaactccttcagaagccgaaaaaccactggaaggaagtgtgcttcagatcctgaacgaagataagacccccaccaaggctttgcatgatagaaacggcttaaaagccggagaagatttaatctttactacaaaaagccaatttgaaaatttgaaaggccagctggaagcggggaaaagttactggctccatgaagtcagaccggcagatggatatgcctatgcagaagatataccttttgtagtgagtttatacggtgacacagatgtaattgtgatgatagacgaaccaacccatgtgatcctgtctaaaaaggccataactggcaatgaggagttcccagggaactatatgagcataaaagacaaggatggaaatgttatggatgagtgggtttcaaaagaacaacctcatgaactcattgcaaaattaaaagcaggagagcgttactggctttatgaaatacacccggcagacggatatgcttatgcagaaagtgttccttttactgtcagcaaaaacggaacagttgatattgttgagatgaaaaatgaggctactgtggtccgcttaaagaaagtagattcatcaggacaattattaaaaggagctgttttacagatcttggatcagcaaaaaaatatggtcatttcagactttgtaacaacaggtgagaccatagatattaccggaagattgacggcaggaaaaacatattaccttcatgaggtgaaagctccatcaggatatctcctttcctctgatgtaccatttacagtaccaaaagaatcaaaagtgctggaagtcacgatgacagatccaaagaggcaaagtcctggatcagataaaatgcatctctataaggcagatgcagcaacaggcaagggattagaaggagtggagttttctatttaccggtctgacggaagtttatgcctgactgtaagaacagaaaaggatggatatgccagattccatattccggcagacggaacctatacctacaaggaaacaaaggcagcctccggctaccttgcaacagatcatatctactatttcaccattaaaaacggtgaaatatcagaaatcagtacaacgtcagtcgtaaattatccttcaccggaagttttgattcaaaaagcggatgctgaaacatgggaagagctggccggagcagaattggaaataagaaacgaagccggaaagccggtattgaccggaataacggatgcaaacggccaattattattccggccacagcatgctggtaaatacactgtacatgaattaaaagccccggaagggcatataaagaccgatacttacctaaccatttatgtaacggatgacggaactgtaaggggagaattggtaatgtataacctccggttgcatggaaagaaaaaaggaattattacggcagcgtatcagtcaggcttaagcggactgggaatcatcaatcataaaggaaaagggttctggggctggctgagcaggcttccaaaaacaggagatatttatctgggcggtggattatttataggaatagggctgatcggtattgctgccgttattgctttcacaaggagaagagataagaaagatgaaaaacgagcttaagaaaagctttgctgctatatcccttatcgcagccatggctctgggatgctgcggtatggtgcatgcagaggaaaagtatcttgaaataaaaaaggaatacaaaacattcataaaggaggaagatggaagatcccagtttaaagacgtctatgaaaaggatggaatcatctacctactgaaatccattcaaatagatgaggtagaagagatcgctccaggtgataccatcgcttatgattctgccccctttgtgggaagtcatgaggaatacacccctaaaaacgcaatagagagaaacggaaaaaggtatattctgaaaaccactgaacttacaaaagtaatcacggaagaaacgacaaaatattcagaagcttctatattatataaaggtgtggaatacatagattctctcccagaggctgcggaagtaaaagtcataaacgaagatttaaagcaggaattaaaggtgagacttccggcggttgattataaaatggaaggtacttactgggattataattttacatttcccattacagtaaccgggtatgatgcagattcctacatgctggggcagattgagatttccaatcattctcctttaatagatcatggagatcagtttctggattatctgaacctgcctacccaatattacaaagttaccaggatccagtgggaggggaagcctgtaggaaaagaaggagaaatgattcgtaaagcgaccgcttatggccggaaactggtgaaagatatcagaggaatatacggaggggaggtaactttcccttctgttgaagccactgtttatcatagcgtttatatggaagcagatgcagagaatgaaaccagccaggttatataccgaaagcaggcgacagcaacctacgaacggaaaggcagaatcggattctggaatttcctaaaatggctgctgacaaactccgttaccttgacaatccttacaattctgctgttaatcctgcttctcttactgaccattgcccttaaaaaacgaaagagaaaggaaaagggagcggggaaagccggggaggaagaaaagcaagataggatcaattgatgtcccggcaatacagatacagtactttccgagaatctgttattgaatattataaattgtaatgctagtattaatataattctatttcatttaaaagaggtgagccaatgacaatttatgatatcgccaggaaggcaggagtttcggccagtacggtttcccgcgtgattaatgataagccgggagtcggagaaacgacgaaggatcggatacgaaagcttttagaagagtataactattcccccaatgaggcagccagaggccttgtgacccaatcctcaaaaattgtgggaatcctgattgaggacatccgcatctctcatcatacggagtctgcctatatcattgaacaggagatgaccaaaagaggctatacctgtatcaccctcagtacgggaatgtctcctgtgaaaaaggcagaatacattaaaatcctggaacaaagaaggatagagggagccattctcatcgggtccatgtttgggacccaggagatagaaaaaagcataaaagagcatttgccggatattcccataatgcttgtaaacggttctctggatcttccgaatgtacgggggatcctggtggacgaagagcagggagtggaggagtgtgtggatttactggtaaaaaagggccgccgcaatctgacctttgccgtggatgcaatcacaccttccaacaacagcaaaatccagggctttaagaacggccttaagaaaaacagtcttggagatggggaaagatttattttttatgcaacggacaatgatacggctccggaacatgcgattgaaaagggtagacaggcaacgaaagaaatcattatgaaatatcctgaggtaaacgggatcatctattccattgatttgctggctgttggtgggctgcagttttgccatgaaaagaagatagctgtcccggaccagatagcagtaattgggagcgataataccctttacggaaaaatctgcattccaaagctgacaacgttggataataagctggtagaagtctgccagaatgcttccaggatcctgctggaagcacttgaagggaaggaaacacctcatgacatgaagatatttaccgatattattcaaagggaaagcagttgaaaagcttattaagattcccaaccggttttcggaaacaactggccgcagacaggaaagcggaagaagcagacttacctgcagcacagattccttcttttacgcaattgattccccaaatagatatcattttgaatttttataatatttatgtcaaaaaccacaaaagtacatgagagaatttagcaattaataggattgattccctgaaaaaaaactgatatcctaaataagaattacgcaatcgattgcaaaaaggaaaggggaacatttatgatttacggacatattgggtcagcggagactgagaaagcttatacggaaaaaatccgtaaagcaatatcgattttaagggagactgacgtgacagagatgcatcatggaaagtatcctttggatggggagaatctgattttgcagattaatgaagttactacagggccagcagaggaaaagaggccggaagtgcatagaaaatatattgatgttcaatatatggtgcgcggtcatgaattgatcgggttttatccggactgcggagatggtgaagtgctggaggatctgcttgaagaaaatgacgttcttttttacaaagagagagacgatgtaaatgaactgatgcttcccatgacagaaggctgctatgccatattttttcctgaggatgtccacaggccatgctgccagatgggagctcctgaggaaataaagaagattgtgttaaaagtaaaagtagatacattataaaaaattgatacgaaagaaatgcgggattaacagaaatgttttttatctgtcccgtcttagccggaatttgttgcagataagggttataaatcgttttttataaccttattgagtgtgaagtaaagaggaaagaatgaagaaccactgtaacgattcagcctccaacccctatttgcccggcaggtttcatgccgaagcaaatggggtttttatattatgggaagtgaggataagctatattatacataacataattgttatatatccggttatatgattggcggcgatgcttgacaaagggacaggttctgcccataataaacattatatagagtttgtgtacgattgaagtatttaaaagaagatgcgtgatgaaaacaagatgattaggaggatcgggctatgaaagagtatcgttgggccacattaggctgtggcgaaattgccaaacagctggcagagaacatgaagaagcggggaaagaccttatatggggttggaaacagaacccatgataatgcagttaaatttgcagaaacatatggagtagagaaggtctatgataatattcatgacatgtttcatgatgatcaggtggatattatctacatttcaactccacataacacccacattacctatttaaaagaggcattaaaaagcggaaaacatgtgctgtgtgaaaaatcaattaccctgaattcccaggagcttgccgttgcagccggtattgcagataaaaacaatctggtactgggagaggcaatgacgatttatcatatgcccctttacaggaaattaaaggaaattgtaaaaagcggccaactggggactctgcgctttgtacagatgaactttggaagctacaaggaatataatatggagaatagattttttaaccccaatcttgccggcggggcattgttagacattggtgtatatgccctttcctttgccagatggttcatgaccgaggcgccggaccaggttctgtcacaggtcaaattcgcacccagcggtgtagatgagcaggcggggatcctgttaatgaacaatcaacaggaaatggcctccatttctctgtccctccacgcaaagcagccaaagcgcggcacagtggcttttgataaggggtatattgaaatctttgaatatcccagggctgacaaggcggtgatcacttacacagaggatagtcgccaggaagtgattgaggcaggaaccacggatgatgccttattgtatgaaatattggatatggagaaggcggtttccaaagaatctgacgaaatgtatctggaatacacaacagatgttatgaatatgatgacgagaatacggaatgactggaatatgaagtacccggaagaaggataaactgtactcttaagaaggcgcaggaaaacgggatgctgttgacactttgcccaagcagggctatactcttgttacagccggaaggctttcgccggattaaccggcagaaatctttccccaacggatttcatgatacgggagaataacaatggatttgtttgattatatgagggaaaataccatgaaaaatgagtctccccttgcatcaaggcttcgcccggcgacccttgatgaggtggtggggcagcagcatatcattggcagggacaaactgctctaccgggctataaaggcggataagctgggttccgtaattttttacggtcctcccggaaccgggaaaactactctggcaagggtgatcgccaatactaccagtgcggattttaggcagatcaacgccacggtggccgggaaaaaggacatggaagagatcgtaaaggaagccaaggattctctgggaatgtatggaaaaaagaccatactgttcgtggatgagatccaccgtttcaacaaagggcagcaggactatcttcttccgtttgtagaagatggaacattaatcctcattggagcgaccacggaaaatccctattttgaggtaaatggcgcccttctttccagatccagagtattcgagctaaaaccgctggaaagggaggatatcagggagctgatccatcgtgcggtttatgacaaggacaaaggaatggggtcctataacgctgtgattgacgaagatgcaaaagagtttctggcggatgtttccaacggagatgcaagagctgctttaaatgcggtggagcttgggatattgaccacggaacggaacctgtcggatggaaaaatccatatcaatcttcaggttgccgaagagtgcatccaaaagcgggtggtgcgttacgacaagacaggagataatcattacgataccatatcggcttttataaagagcatgcggggttcggacccggatgcagccgtttattatctggcaaggatgctttatgccggagaggatataaaattcattgccagaaggatcatgatctgcgctgcggaggatgtgggaaatgcggatcctcaggctcttgttgtagcggttgctgcagtccaggctgcggagaggatcgggcttccggaagcccagatcatcctgtcccaggcagttacctatgtagcctcggcgcctaagagcaatgcagcctgcatggcagtgtttgaggcactggattcggtgaggaaccagaaaaccatgccggtgccggttcatttacaggattcccactataagggagcatcaaagctgggccatggacaggggtatctctatgctcacgattatcccggcaattatgtaaaacagcagtatttacccgatggaatggaaggaacagagttttaccacccaacggaaaatggttatgagagtaaaataaaagagcgtttaagggaactaaaaaaataacttttctttttttatataaaggtatataataggcgtatcatacgacctgatttagcatgatttgggccggagcaacccttccggccatctgttgcgatattctatcgtgaagcattcccaagattatgaaacgactgttataaggaatcatgaaggagaataatatgcgtgaaaaattacagacattgccgttagcggaactaaaggagcttgccaaagcccagggaatcaagggctgcagttccatgcgaaaagctgaaattatagatttgctttgccaaaaagaagaggggacatctgcttttccagtttcgccggggagtgtttcagcagaaaaggcggaggaagtaaaaaaagaggttcctaaagctgcagcccatccggcggcgcagacccagtctcagccagagacggtaagccagcagggacagatgaatggggatcagcagatgatgtccgcagcaggcagccaaagaaagacggttgtccgttcctaccgccaggaaggccagcaaaggccggcaagctaccgtcctgctccgggaaataacacagagtcttattccagaaatgaggctaggacagaatctgctccggaagaaccaaaagcagattttcagccaagtcctgaactgcaggagttagacagcggcatagaagcccatggtattttagaagtcatgcctgatgggtttggctttatccgctgtgaaaattatcttccaggggaaaatgacgtctacgttgccccttcccagatccgccggtttaatatgaagacgggagatatcatccacggaagccgcagggtgaagacggctacagaaaaatttgccgctctgctatatgtaaagaacatcaacggctatcccaccagcgtggcggaacgccgtccaaactttgaaaatatgatccccatattcccggatgaaagacttcacatggaaacacatggagggaagaacaccactgccatgcgtgtcctggatctcttagctcctattggaaagggacagagaggaatgatcgtatccccgccaaaagcaggaaaaacgaccctgcttaaagacgttgcaaaggccattaccgtaaaccacccggagatccatctcatgatcctgctgatcgatgagcgccctgaggaggttacggatatcaaagaatcgatttacggaaacaacgtggaggtgctttattccacctttgacgagcttccggatcgccataagagggtatcggaaatggtgatcgagcgtgccaagcgccttgttgagcatggccgggatgtggtgatccttttagacagcattacccgtctggcaagggcctataacttaacagtggctccaagcggccgtaccttatccggaggtctggatcctgcagcccttcacatgccgaaacggttctttggcgcagccagaaatatgagggagggaggcagcctcaccgttcttgccaccgctcttgtggatacaggcagccgtatggatgatgttatttatgaggaatttaagggaaccggcaatatggaactggttctcgacagaaaactgtctgaaaagaggattttccctgccattgacatccttaaatccggtaccagaagggatgacctgcttctttccagagaagaggcggaggccgttgatatcgtccggaaggctaccaacaccctgaaaccggaagatgcggtagagaaaattctggatttgttctcaaggacaagaaacaacagggaattcgtggaaacctccaaaaaaatgcgctttttctagggaatgcgggtttttgcagaaataaatgcttgcattaaaaaaaaatttatgttatactgtgtaagctgtttattagacaaagtcggtttgcggactgcgatttaatagaaatcagagtatgcgaggtgaaaatcatgaaagagggaatccatccaaattactatcaggcaaaagtagtttgcaactgtggtaatgaattcgtaactggttctacaaaggaagatatccacgtagaagtttgttctaaatgccattcattctacaccggtcagcagaaggctgcttccgctcgtggacgtattgataaattcaatcgtaaatatggcgttaaggctgaggcataatttctttgatgaatgcaggcgaagcacagcatgaattcaggaaatcagccgttctatgcgttcattgggcgtatggaacttccttattatatcaggggcaaagaaaaggttgagtttggtggaaacactttagctcagccttttttcagatttgaacaagtgaaaagcttccattttaaacagagaggtggtttggcgtatgaaatattcaggtatcggcgggcaggccgtgattgaaggcgttatgatgaaaaacggggatgagtatgccacagcagtccgcaagccggacggaaccattgaagtgaaaaaggatacttatgtcagcatgggagaacgggtaaagcttttttctctgccttttgtgaggggaatattcagctttgtggactccatggttttgggcatgaagtccctgacattttcagccagcttttttgaggacgatgaggaggtttcagagccttccaggtttgaaaagatgttggagcggatgtttggggaaaagacggaaaaggcactgatgagcatggtgatggtgttttccgtggtaatggctatcctgatctttatggtattacccatgttccttgcaaacatatttcaccaatttataaagtcccagacccttatggctattttagaaggtgtgatccgtatcgggatcttcatcgcttacattggtctggtctcacgcatggaggatatccgccggaccttcatgtatcatggagcggaacacaagtgcatcaactgcctggaacacgggcttccgcttactgtggaaaatgtgagaaacagctctaaagaacataaacgctgcggaacaagctttcttttgatcgtcatgatcatcagcatcctgttttttatggtggtgagagtggatacagtgccccttcgggttctcagcaggatcatattgattccgttcattgccggagtatcctatgaatttttgcgtctggcagggcgcagcgaatcaaagctggtagatttattaagccgtccgggcatgtggatgcagggaatgactaccaaggagcctgatgatgagatgattttagttggaatcgcttctgttgaggcggtatttgactggaaagcatttcttgacaggaatttcccggagaagagtgcatgaatctgacattacagcttttattggaagaaggaacggaaaagctgttaaaggcaggggtggaagaggcatctcttgattccaggtacctgctgttagaggcgttttctacggatatgacccattttctcatggacagaaacagaaaacttccggaagacgggcacaatctgaaggcaatatgggaatatcgttccatgatcaacaggcgctcccaaagaattcctcttcagcagatcattggcagcagggagtttatgggacttgagtttttcgtcaatgagcatgtgctgatcccaagacaggatacggaaactctggtggagctggtcttaaaggattataagggaaagaatccggaacttttggatatgtgtacgggaagcggctgtattgctgtcagtttggcaaagcttggcaggtttgaccgcgtgactgccgtggatatttcaagggaagcccttaaggtggcggaacaaaatgcgcggaagcatttgggagaaggaaaagtgacgctgacggaaagcgatttatttgcttccttagagaagcagaaaaagtttgatgtgatcgtgtcaaatcctccttatatcccgacaaaaataatagaagggctgcagccggaggtccgggatcacgaacccatgctggccctggacggaaaggaagacggactgtatttttacaggaagcttgctttggaaagccgctcacacatggtatcaggaggagcggtttatttagaaatcggctatgaccagggagcagcggtcagtggcttattaaaggacgctggctttggagaaatccgtgtggtcaaggatgcggcaggactggaccgggtggtttgttcacgaaagcaatgagcagtccttaacgggaaattcaggaggttaccaatgtttgatagattagatgatattttaattcattatgaagaattaatgcaggagcttaacaatccttctgtaacagaggatcagaaccggtttcggaagctgatgaaggagcaggcagatctggcagagctggtggaggcttatacccagtataagaaggcaaagcagacggtagaagacagcctggctcttctggaggaagagagcgacgaagaaatgcgggaaatggcaaaggaggaattatctgatgccaagaagcagatcgaggcgctggaacaggagcttaaaattttacttttgcctaaggatcccaatgacgataagaatattattctggagatccgtgcaggagcaggcggcgacgaagcggccctgtttgcctccgagctttaccgtatgtatgtaaactatgcggaagcacaccactggaaggtggaactgatcagcgtcaatgaaaatgggatcggcggcttcaaggaagtggttgccatgatcaccggcaagggcgcttactccaagatgaaatatgaaagcggcgttcatcgggtacagcgtgtgccggaaacagaaagcggaggaagaatccacacctccacggctacggtagcagttatgcctgaggcagaagagtttgacgtggtgatcgaggataaagatgtgaggatcgacgttatgcgtgcctccggaaacggagggcagtgcgtaaacaccaccgactcggctgtccgtctgacccacatgcctactggaatcgtgatttacagccagacagaaaaatcacagcttcagaataaagaaaaggccttccgtttactgcgttccaagctttatgacatggagctggagaaaaggcagaattcagaggctgaggaaagaagaagccagatcggtacgggagaccgttccgaaaagatccggacctataacttccctcaggccgcgtaacggatcacaggatcaagctgaccctttataagatcgattccattatgaatggagacattcaggagcttttggattcccttattgcggcagatcaggccgtgcgcttaagcaggttaaatgaagaggcgtaaaattccgtatctgcggtgttttctggtttattaaaagattatctgtcagccctgttccatcaggggagggcactgataaaatagtcgatttttaataattgtaacttacaaaaaagcccaaagagccttgctacaaaaaactctttgggctttttgaaaaggatagagcgtattcgccctatttttcatcatatcattataatttgtttcatattaactgcaatgattaccatggcaccctgcatttccattccaatgaaacctgatgatgttacttcataactgtgtctgtgttttaattagctgttcttggcctcaatcttatatctcccttttgctttcgctttgaaatgatctttttcctggaattcagcctgttcactccggggttttttcttccggtttctatgtgtgacaatgctgtttagcccggatatcagatgatactggttttcttttgaagattctatgttatctttacaggagtaggccttatttcctatgacttccacagttatcatgtccgaatctctgcttttttaaccagggaagaaggtttttacttgtctgctttttcaacacttgtaatggctgcagcagtaataattttttttctgtcatggagtatgggttttatatctgaaaatagaagcatctgctgttttgtgtcctgcttttgcatcagattccttcaatgtttccaagtgctccaaatcctccaaatcctcagaacctatttcctctgcaatttaaacagctttaaatttcaacataatcaaaagttccataccctttaagcgaagcttacagaactttgataaagaactaggattgaatacctctttaattcttctaagcaaattatcttttgaaactgcaatgtcataaatctgcagtgtcatcaaatgaggggggaaggagttgaggtgccgaagacacttttatacaaattctgtgtctgagaaaacatatgctggaaaggattgccacattgaaattggaaaaaagattcatcgtattaaaaattaaactatgatattatgtaaatatgcataaaataatgaaaaaataaaaaataatattaaatataacacacaaaacaggtggataaacctgtactcttttcacaaaagacttttacatttatttacaggggtgaaaatatttggataagcgaatgaggcaaattttggatattttatcagacggagaatattatactgcagaaatgctttcgaaagaagtccattttggaacgaagacagttcgaaatctgctgaaggacatcaattatgagatcgaaccgtacggggcttcggtgatttcaaaatatggagtgggatattatctgaaaattacggatgaaaataaatatgctgcattctgtggaaaaaagtacaagaatatgctggatgaatatcttccttccacctcagaagaacggatccagtatctgctggaatatttatttaacagcccgtcctatgtaaagctggatgaattaagcgaaagcctgtatatctccaagcgtactctgacggcggatttaaaggaagtggagcatttcttaaaaaaatacaacatcagactcatccggaaacccaattatggcataaagctggatggaaatgaatttgatgccaggctgtgcattgcctccttctcgggaaaacgtcttcataagggaaatcaaagcatggatcagattgctgcctgtgtatcgggagttgtcaaaaagaatgattttctcataactggaacggcctatcagaatctagtggtccatctttatatcgctatcagccgcattatggaaggccattatgtgcccatgccggaggaacccatagaaaatatgagtgaccagtacgaatatcagatagcgggagccattgcggcgcagatcgaagaaacgtttcatattgcctttcctgaaaatgaggttgcatatatcgccatccatctggccggaaaaaaactggtgtttcatgtggagggcggggagccgggaagcaacgtgattatcacccaggaaatcagcgatctggtgaccgatatgctggatcgggtatacggtctgttcaaatttgacttccgggatgatttagagctccgcatgtttttaagtcagcacctggtccccttaagcgtgcggatcaagtatgatatggacttaaagaatcctatgcttcgggatgtgaaggaaaaattctgcttatcctataccatggcatgcagcgcggttactgtgatcaatgagcattacggagtttccctctcagaggatgagattgcgtactttgcctttgcctttgcccttgccctggagcggaaaaagacggaaatcaagaagaaaaatgttttgctggtgtgttcctcaggaagaggaagcgcccagctgctccaatataaatacaagaattcctttggctcttacattaacgaaattacggcctgtgacgtgggaagcctgtataaaatggatttctcccaatatgattacatttttaccacggtgcccattccggtggcggtcccactccccattcaggaggtgcgttactttctggatgatgatgacattgtgaatgtaaaaagggctcttgcggctgataaggagtcttccgtggggtattattatgaaagggaaatgtttttgacccatttaaagtttaaaagcaaggatgaggtcctgcgttttatgtgccggtttgtgactgaaaagaaacaccttccggaagaattttacgaatcggtgctaaaaagagagaagctggccaaaacagcctttggcaacatggtggcaatgccacactgctatgaagctatgagcaatgaaacctttgtgtgcgtgggtatactggacgaagcggtggactggggagaccagaagatacgggctgttttcctgatttctatagccaataaagaccataacagtgtggagctgcagcggttttaccagatgacggcatcttttgtgctgagtcagaaacagatacaggatctgatcagaaaacaggattatgatacctttataaaggccatgagtgaaatagaagcccagatgccccgggtattataaacaatttaagtaaacggatataaaaaacagcagccttacggaaaatgaattccagggctgctgtttttagccgtacggtcagtcttcctcaaacaggcaggctccgttggtttcgatcacatgtttataccagtcaaaggattttttcttaagccgtttgtaagtgccttttccataatcgtcacagtccacatagatgaagccgtaacgcttggacatctgcttggtggattcggacacgatatcaatacagccccaggaagtatagccaaggcaggtgaccccatcctcctcaatggcatccagaatcgctttcatgtgctctttgaaatattcaatacggtacggatcgtcaatggttccatcctcatttacaacatccgttgcgcccaggccgttttccacaatgaacagaggcttccggtaacggtcatacaaatcgaccatggagatgcgcaggccggtgggatcgatctgccagccccagtcagaagctttcagatggggatttttgatggcgttgatcgtattgccggaggttacgttcaagttggaggtatcctttgccgcacaggaagagtgatagtaggaaaaggagacgaaatcaacgggataagccttcatgatctcatcatccccgctctctttctttatatggatgccatggtttctgaacctggagagcaggtaagacggatattcgccgaacacctgggtatcgctgtagcagtaagtgctccgcatggcctgctgggcttccagaacatcctcgggcctgcaggtataaggataataagtaagctttgtcagcatgcagcccaccatggagccgggaatgatttcgtggcagatcctggtggcaagagcggaagccacaaactgatggtgcatggcctggaagatcacttcttcaaagttctgcccagggaagcggtcttcgatcagggcgccggtagtatagggatggcggatcatggaatcaacttcattgaaggtgagccagtattttactttatccttatagcgccggcagatagtttccacaaatcttgtgaataagccgatcacttccctggagtaccagcctttgtagtttagaaccaggtttaagggcggctcgtaatgtgacatggtgaccagcggctcaatgccgtatttttgaagctcatcaaacacattgtcatagaacttcagcccttcttcatttggttcggcgtcatctgcgttggggaagatcctggaccaggcgatggacatgcggtaaaccttgaaacccatttccgcaaaaagacgtatgtcctctttataatgatggtaaaaatcagaaccatgccttttcggataatatacttcatcctccgtggcaagggcctcttcaatgtctttgctggtcaccgcattgtgcgccctgtaattggtcacgtcggtatcgaaatgcgcccgagcgcagtctgatacggaaattccttttccgccttccttccagccgccttccacctgattggcggcggtggccccgccccaaaggaagccttcagggaatgcttttgtttgatccatattgatccctcctgatttatttttgataaaaccattatagcaaagttgattttttatatccaagcacactttttccaatttcatggtggagtctgtttccaggagccgtgagaagaaaaaagtgccattatgaaaatggaaaaatagagcatggagttcaaaaaaaaattatgataatatgtgaatacgcataaaagagtgccgccattggcggtggagatggaggaaaagatgaaagacaaagtaatgaacggcctgctttcggttgcaggcacaatgcagacgcagaggcatctggcagcagttaagaatgcgtttacgagtttgcttccgatcataataatcggttcattctgtacgctgttttcaaatgttatctgtaatactacaccgggatatttcagccttgccaatattccggggctcagtttcctcggcaagctgaatcccatgtttaccgcggcaaattacgggaccatgaatttcattgccattggtatcgtgattctcatcgcaatggagctgggtgaacattacggaatatccgataaggcgcttccggtagttgcgttaggcgcttacatttccctgtgcgcatttactgcatcagggaaagcggcagacgggagtgtggtcactgttgccaatgtactttccagagagtttaccaatgcccagggcctgttcgtggggatgttcacatccttggcggcaacggaaatttactgcaggctggtaaacagcggaaagcttgatatccacatgccggacagcgttccttccaatgtcgcccgatccttcacgatcctgtttccgtcactcattacgatcctcattgtatcagcttttgggatggtatttgaaataatcacgggcatgacactgtttcatgcaatcacggcatttattcagaagcccctggccaatgtactgaccagctttcccggatatgttaccctggtgttcattacaacggttctttggacctttggtattcatgggactcaggccacaaaggcggtatacgagccaattttgttagcggcatttgctgaaaatgaggcggcttatgcggctggaacagcgattcccaatatcatttccacaccgtttatgtcatgcttttccacggtgaccggtgcggggatcacaggcggactgattatagcaatcatgctgttttccaaaagaggggattacagggcgatagcaaagctggcgatcccgtgtgcgttttttaatattaatgagcccttaacgttcggtcttcctatcgttatgaatccgatccttgcgattccgtttatgatcgcgccggcggtttccgcaacctttgcctatcttatgacaaatatcggcttctgcggaagaatggttgtgaacgctccctggaccactcctcccggacttatggctttcctatgctccggcggaaatgtgggtgcggcgctcacacagattatttgtattttacttgctttccttatttacataccctttgtccttgcggccaacaaacaacaggttgaaacagcggaataaaaagaatagaataacagcgggaggtgattatgggtttgaaaggtaaaaatgaaagaaaacatatgacagaacacatgccggcggcgccgggcgctgcattattgccggaaaggcagatgcaggatgttttatcaaaagccaggatcataacttatatctggatcatcctttttcctccttacggactgtaccgtgtctggagcggggaatcaacattccgcagatcggaaaagtgggtttggacgctggtcgcggccgcttacctcattggctttttcagactcataatcacaggctaggagagaaaggaatgttgacatggatattgaaatggtcattatgaagcttgtggtaagcagcggaaatgccagaagtacggcaattgaagctttacgcgctgccagggatgaaaattttgagtatgcagataagctgatgaatgaagcagatcagatgatccttcagtcccacgaggtccagacggaaatgatccagaatgaattgaacggcgaaaaagtggaggtcggccttttgatggtccatgcccaggatcatctgatgaatgccatgacggtcatggacctctgcaaggaaatgattgagatcctgaaaaaacaaaaataaaaggtggaaaggaagtatgtttatgaggaatatcgtattattctgcgctgcaggcatgtcgaccagccttctggtaaataagatgaaggaggcggcggcaaaagaaaattatgagtgccagatccatgcgtacgctctggcaagcaccaggaataaaggggcggatgcggatatcatccttttaggccctcaggtccgtttcagcaaggcaaaggtggaaaaggactgtccggggaagattatcgaatgtattgacatgcaggcttacggcaccatgaatggagcaaaggtcatcgctcaggtgaggaaggcattgggagactgaaccttgcattcagaggctttttccgggggataaaataaattgcggaagcggtttttttcagaacccgtgcaaatttgaggaaaaaatggacttggcatatattacggttaataaaataatggaaatgtttcttattctgatgataggagcaagcgctatataaaccgggctggccgttacagcaggattatccgcagccagtttcctgctggcgatcctgttatccggaccgtctccattaccatattgactgccgcggcttgccccagcggagccatgggagccatgttcgcgctgcagtacgggaaagacagcggttacgcctcaaaattactggcggtcacaacggccctgtcattgtttaccatccctgccgtcatgctggccggcagcgcagttttataaacaacagagaggatgaggaaaatgattataatcaatgcaccattaaaagcagaggtttttcagaaggctgcggaggaagaggggcttatatttctcaaaaaatccggaatgaaacttgaatttgaaaatccggcgggaaatgatcaagagatggctgctgcactgaagaaaaagtgcaaagggatcaaagagctttcggcaatttattttcaggtgagtgccgggtaaaattacacgcgccaaaatctctcaatttcaagcagatgaaaagaaggtacagaataaaatagtatgatgcattttcccgcagattgttttatcctatacctttaaaccatggaatcaaaatccggcagcccgttcctattgtcctatcatgatccggataatttcctcgttggtcgccctcatcccttcttttcccaatcttcccacattcctgagggtagcctctacgcccttggtgacgatcccgtcgccgtccaggaattgctgcccttccatgtacatgttgtagcctagtattccggcttctatggaggaggcgatcttcgccgcacaggaggactttgccccgtcgcatacaatgccggaaacaatggcaagggcgttgactatggtatgggtgacttctttataacctcctccgcagatataggcaattccggcccctgcaccggcccctgcattgactgccccgcaataggcagataaccggccgatgggggttttctggtgtatggcggccaggtttgacaaggctaaggcccggtacattttttcttcgctgacctttaaacccattgcataaacgatgacaggtacagaaacggtaatcccctgatttccgcttcctgaattgatgatgacaggcagtccgcagccgttcatgcgggcgtcggaaccggctgccgccatggcctttgccttaagagccagatcattcccggaatttttaaggagcactttgccgatattggcaccataattgttcttaagcccttcttcggcaatggcccagttgtaccggatctgacggtccaggatctccttaatgtcgggaatgtccaccgaattaatgaagtcccagatatcctccatattaagcaggctccggtcggtcaagggttctttttctaaaacagcttctccctgccttactacggttccgtttttttcaatgagaacgatgtttgtgtggtaatcagcaatgcgcaccctgctgtaagaagcgcccttatacagggtgacaaggatatcaaagcagattccattgtccaggtgttctaccgtgatctccctttcctctataaatgttctcatttccaggatctgctcctgagagacatctgctataacctccagctctttttccggatctcctgccacgattcctgctgccactgccgcagggattccctttaaatggcctgtgtttggaacgatcacggatttcacgttcttaataatgcttccgcttgcagccaccactgccttatcaggcatttcccccagtgtttttcttgctactgcagcggcataagccagggcgattggctcggtacagcccatggcaggaaccagctcttcttttaatatttgtacataagccccgtattttagatttgccttctccatatgacacaattcctttctgaatggttcattgatttttaaagacttttttgaataagcattgattacttgttggttataatgtaccatagataaatgaggaagtaaaatttaatgtttttaagataacgtttaatatttttaaatcaacattaagaaaggagtttaaggatggagcttcgggagataaagacctttttagaagtggcaaacaggaaaagcttttgtaaggcggctgaaaaactgggctattcccaggctgcagttaccgtgcagatcaagcagctggaaaaggaattaaaggtccatttgtttgaccggatagggaagcagacgaccctgacccatgagggagaaactttttatgaatatgcggctgaggtggtaaggaacttaacccatgtgaaaaacatcttatcaatttcctcagagcttacgggaagattggtcatcgggaccattgagtccatctgttccaccttatttccgcccttgatccaggagtttcaccgcctttatccccaggtcaatgtaagcattgtggtggattctcccagcgcccttcttgacatgatgaatcacaataccattgacctggtatattttcttgatgagcttatgtatgatgcaaaatgggtaaaaatcatggaaaagcctgaaaacatcatttttgccgcatcaaaaaaccatccctttgcagaggaaataagtcttaccatggatcaggtcatttctcagccaatgcttcttacggaaaaggatgccagttaccggtttatgctggagcagcacctggcttcctgcgggaaaaaggtccatccctttctggagatcggcaacacggaatttatcatcaagctcctccgcagcaatacaggaatttcctttctgccggagttcaccatttgcagggatattgaggaaggaattttgacacctcttaaaatgaaggactttcacttgcagacctggagacagatggtctaccataaggataaatgggtcagcagggagatgaaggcatttatagagctggttcaaaggctggaacaggagagttaaaaaaccgcctgccaaagccttccaaaagagtgattgtacaggctgttttcatgtgatatactgaacataaacgaataaaaatgcacggaggtttgagatatggatgcgctaaaaataggaatcatgggaacaggcgggattgcctcaacactggcaaatacaatggttcagatgcctcaggtggctctgatgggagcaggatccagaagtctggaaaaagcggaggaatttgcggcgcgtttttccatagaaagggcgtatggctcctatgaggagcttgtaaaggatccggatattcaattgatctacattgccacgccccattccgagcattgcagcaatgccaggctgtgcctggagaatgggaagcatgttctctgtgaaaaagcctttgcagccaactacgcacaggcaaaggaaatgaccgatctggcagtggaaaagaacctgatgataacggaagccatgtgggtacgctacatgcccatggcaaagaccttaaaagaggttttagattcaggcgttatcggagagccaatgacgcttactgctaatctctgttatctgatctcaggcaagccgcgcctgataaagccggagcttgcaggaggggcccttcttgatgtaggtgtgtatacccttaatttcgcttcccttgtgtttggggatgagatttcagacatccagtccagcgtgatcaaaacggacagcggagtggatgcccagaacagcattaccctgtgctatccgggaggaaagatggcgatcttaaatagctccttacgggtgctttccgaccgcctgggaatcatctacggaaccaagggatatattgtagttgagaatgttaataattttgagacaatccgggtctatgacaccaaaaggcagcttgtggaaaaccatcttcagccggagcagatatccggatatgaatatgagatcaatgccagcggggaagccatcaaaaacggctggacccagtgtccccagatgcctcataccacaaccctgtccattatgaaggtcatggacgagttaagaaggcagtgggggatctgctatccgtttgaggcatgataaagaggaaacagaatgtttactagaaaagatttactgaaactgctggctcctctgatcgtggaacagatattgatcgtcctggtgggcatggtgaacgtggtaatggcagcagctgttggagaggcctcggtttccggtgtttccctggtggaatccatcaacatcctgatcatacagatgctggcggcattggccaccggaggggcggtcatatcctcccagtatcttgggaaaaagcagtcggagaatgcctgcaaggcagcagggcagctccttggagtcacaaccgtgctgtccgtgcttgtaaccctcattgcactggcaggaaggggaagtctgttaaaggtcattttcggcaacgtggatgaggaagtcatgagcgctgccgtggtttatttctggatcacggccctgtcctatccctttgtggcagtctataattcctgtgcggccttattccggtccatgggaaattccaaggcatccatggcagtttccctggtgatcaataccgtcaatgtcataggaaatgcggtctgcgtatacggcctccatatgggagtgtccggccttgcctggcccaccttattcagccgtgtggctgccgcagtgctgatgcttttcatgattcagaatcctaacaatacggtgaggatcaaccacctggcagagcttaagccaaaccttcccatgattaaaaaaatactgtccatcggcattccaaacggcttagaaagcggcatgttccagttcggaaagcttgctcttcaaagcctggtctcctctttgggaacagctgccatcgccagctatgcggtggcctccaacctggtaacgctgctgtatttgcctggaaacgccattggtttgggcctgatcaccattgtgggcagtgcgtgggagctggggagaaaaagcaggcagagaagtacaccaggtttctggttatggccaattacgggatccttttgctgctgtgcgggatcatggtggtattttcagaccagcttgtttccgtgtacaatctttcaggagaagcggcagaaatatccgcccaaatggtggtagcccacagctatgccatgatcgtgtggcctctggcctttaccattccctatgccttaagagcttccatggatgccaaattcaccatggcagtgtctatattttccatgtggctgttccggatcgcctttgtttatttctttgtccgcgttatgaatacaggtgtcatgggcgtatggtatggaatgtttattgactgggttttccgcgctgttttattcagctggagatttcggggaatcgaaaaaagagcagtgtctgtttcttaaacagcactgctctttttatgcgggcaatgagacggacggatatgtctgcatattcatcgcagttcattcatccgtccgctggcatccacgtaggagccgtctacaacacggcttacggccattagtccgagtaggccgtcggaattcgggttaaaatagtaccagaagccatcaattttatgccagccggtgaccatgatcccgatctggttcgtataaaaccagccttcgcaatccgggtcataaacccagcccgttaccatagagccttcctcgtttccctcataaggattaaaataataccatcggccgtttagaaaatgccagccggtcgctatgtatccattgtccataaaataataggaatttccctgatattctgcccatttcccggcgggaaaggtggaattccactggttaaagaaacgccagccaacctcatcctttatccaggtgccggccaggtaaatggattcatcctttgtatgggcaaagctgtcaaatgggcttgcgccggcaaaaagaaccagggaaacagcggcagcggcagctgcacggcgaatgaagtttaagcgggaaatatttttcataaaaacgtcacctcctgaatgcaaaagataaggataactgctttgattataggcgaaggtcctgaaaaaaacaatgagaggaagaaaaccgtaagatttttgtttgaattccgtccgaatctgaggaaaatcatcttgacaggcgaaacactatttgttatattacatatagaacaaataaagcaatgttttacataaccggataaaaaggaggaagcaattatgaatatcaataaattcacccaaaagtcaatggaagccgtccagaattgcgaaaagcttgcgtatgaatacgggaatcagcagatagagcaggaacacatgctgtacagtcttcttaccattgaagacagtctgatattaaaactcattaccaagatgaatatacaaaaagagcagtttttaaatgaaacggctcaggcaatcgaaaaacttcccaaggtcaggggaggacagatatacatcagcaatgaattaaacaaggtcttaattggcgccgaggatgaggcaaaggtcatggggatgaatatgtttccgtggagcatctgttccttgccatgttaaagcagccttctaagccggtaaaggagttgttccggagttatggcataaccagggaagcctttttgcaggctctttccacggtaagaggaaaccagcgtgttgtaaacgacaacccggaggctacctatgataccctgaccaaatatggctatgatatggtggaacgggccagggaccagaaactggacccggtgatcggccgtgacagcgagatccgcaatgtggtccgtattctttccagaaagacaaagaacaacccggttctcatcggggagcctggggtaggtaagacggctgtggtagaaggtctggcccagaggatcgtccggggcgatgtcccggagggattaaaggagaaaaagctgtttgctcttgatatgggggcattgctggcaggcgccaagtaccggggagaatttgaggaacgcttaaaggcagttctcgacgaagtgaagaaaagtgacggccagatcatcctgttcattgacgaactccacaccattgttggcgctggaaaaacagaaggatccatggatgcgggcaatatgctgaagccaatgcttgccagaggcgagcttcactgcatcggtgccaccactcttgatgaataccgccagtacattgaaaaggaccaggcactggaacggcggttccagccggtcatggtaaatgagccaagtgtagaagataccatttccatattaaggggattaaaagaacggtatgaggtctatcatggggtaaagatcacggactctgccctggtgtcggcggcggctttgtcagaccgctatatcagcgagcgttttctgccggataaggccattgacctggtggatgaagcctgtgccatgatcaagacggagctggactccatgcctgcagaacttgatgagctgtcaaggcgcatcatgcagatggagatcgaggaggctgccttaaagaaggaaaccgaccgtttgagccaggaccgccttgcagagcttcagaaggagctggcggagcttcacgatgagttcacctcccagaaggcccaatgggaaaatgaaaaggcatccgttgaccggctgtcctctttacgggaagaaattgaaagcatcaaccgtgagatccaggcagctcagcaaaagtacgatttaaaccgtgcggcagagctgcagtatggaagacttccccagcttcaaaaggagctggcggcagaggaggagcgggtaagaaaccaggatatgagccttgtccatgaaagcgtcacagaggaggaaatctccaggatcgtatccaagtggacgggaatcccggtatccagactgacggaaggggagaggaataagactcttcacctggataaagagcttcataaaagggtcatcggccaggatgaggcggtatcaaaggtcacggaggccatcatccgttccaaggccgggatcaaggaccccacaaagcccatcggctccttcctgtttttaggacctacgggtgtgggtaagacggagcttgccaaagcccttgcggaaagtctgtttgacgatgaaaacaacattgtcaggattgatatgagcgaatatatggaaaagcattccgtatccaggctgattggagcgcctccaggatatgtgggctatgaccagggcggccagctgacagaggcagtccgtagaaagccctattccgtggtgctttttgatgaggtggaaaaggcccatcccgacgtatttaacgtactgttacaggttcttgacgacggacggatcacagattccacaggaaagaccgttgactttaaaaacaccatcatcatcatgacttccaacatcggctcccagtatctgctgacaggaattgatgaagggggaaatatcagaggagacgcggaggaaatggtaatgaatgatttaaggaaccatttccgtccggaattcttaaaccgtcttgatgaaatgatcctgtttaagcctcttgataaggaaaatattgcgggaatcattgacctgctccttgctgacttaaataaacggatcgaaaatcaggaattaaccattgaactgactgaccaggcaaaggaatttgtggtggaacagggatatgatccggtttacggagcccgtccattgaaacgatacttacaaaagcatgtggaaaccctggcggccaggatcattcttggagatgaggtccgggctggaaatgtgatcgtcattgatgtgtcagaagacggccagaagctgatcgcctatctggaataagaggaaagaaacgaaaggtctgatttaaaaaggcgctgcaaagggataaggattcatccctcttgcagcgcctgtatcttttatgcctgccagagaatatctctgttaatggtccggtaaaacaattccctgatctctttttcatccctggtctggcccagaatccacatcagctttgttaccgtggcttccagggtcatatcataagcttccaaaagccccagttcttttttgatggagtgccccacttcgtatatggacatattgctgccctcattggtcacctgggtggtcatgaccacggtttttccaagggagatccactttttgactgctttataaaaatctcctgtgtcataggagggaaggccgccgaccccaaaggattctatgattaccgcgtcatgatgctctgccatatagtccaggacatccgatcccatggaagggatcagcttcatcaatgccacatgaggatttaattcccggaaaaactgcacctgcctggaacaggaggctttgtcgtccacgtaaaaaagcacatacccatcctggatcgcagcaatataagggaaattaatgctggaaaaagcattgtagctcttagtccgctcctttttccccctggtgcctgcgatggcctttccgtcaaagactatggtgaccccatgggcctttggttcgcttgcaaaccggagactgtctgacaaattggtgcgtgcatcggtattttccatatcaatgggtctctgtgctccggtgatgacaatgggtttttccgaattctgtaccagataggagagagctgaggccgtgtaagccatggtgtcggtgccgtggcagatgacaaagccgtcgtaatcctcataatgggtctcaatggcttttgccatggcaagccaatgatttggctgcatgttggtgctgtctatattgagtatctgcaggctgtctgcctgacagaatttggatgcttccggaacataggaaaggatctcgtctgaggtgaggagtggttttaggccgctgtcacttcgcttacaggcaatggtgccccctgttcccaacattagtatttttttcatacgaaattacctcctgagggatatcaatatctgattgtaacactgatttccccgttcgtacagtggaattttccccaatggtccttaattctttctttgagtgattcacaactgtggaaaattatgataaaataaatatgatatcagaataggaggaggaaaaaatgtttaacatacctaaagatccggcgattctgttaagttatatcaatactcaattaagagattattatccttctctggaggaatgctgtcatagtcttgggatccgggaagaggacctggcccattctttggctgcaattgattatcattacgacagggagagaaatcagtttgtataaaaaggggtcatcgccgcagcgatggctctttttgcaagagcaattattccaaagaatgtgcttgcatattccttgggccaatgccgcttagacaggagggatatattatggaaacgatttggacacagacggttggaatatggaactggttgatcgatcatttgatctatatcaatctgatcctttccattatcattgtgtttttccagaggcgtgatcccaaagcagtctggacctggcttttagccctgtattttattcccgtattcggcattcttttttatctgcttttgggccaggatatgagaaagggcaagatgttccgggtcaaggaagtggaagaccgggtgcgttattccgcaaagaaccaggaggagtttttaaaaagccatgacatcagcctggtgtcttcgctatcccgtgattatgcggatctggtggtgtataacttagaaacctccgggtctgtgctgaccgttgacaacacggtggagatttttacggacggggaggaaaaatttaaagacttaagagccgagctttcggctgctgcttatttcattcatttgcagtattacattattaaggatgacgaattgtttgattccataatccccatcctcatagaacgggccagggctggagtagaggtgcgcattctctgcgacggcatgggaggacgtttcatggcaaaggacaaatggaacaggctgaaagaaaacggggtaaaggtggggatctttttcccgcccatacttggccgtctccagcttcgggtgaactacagaaaccacaggaaaatcgtggtcattgacaaccgggtgggatatgtgggaggctttaacatcggccgggaatacatttccaaggacaccaaattcggttattggagagacacccatctaaagctccagggggctctgtgctgagtcttcagatccgctttgccctggactggaattatgcggcaggagaaaacctgtttcggaatatgaaatatttctgcgaggatgaggacggaagatgtatagactatatgggtgtggttgatatgaatgacgagagaaaacaccttgggatccagattatcgcaagcggcccggatgccaggagccgccagatccgtgacaattatatccggctgttttcaaaggccagggaccatatttacatccagacgccctactttgtgcctgacgacgccgtgcttaccaccttgcaggtagcggcacgctccggtgtggacgtaaggctcatgatcccctgcaagccggaccacccctttgtttactgggcttcctattcctatgtgggagatcttttatccgccggggccagatgctatacctatgaaaacgggtttctccactccaaaggagttatgaccgacggaaaggtcagttcctatgggaccgccaatatggatatccggagctttgaacttaattttgaagtaaatgcggtgatctatgacgaggaaacaacccagaggctggaagaattattcttagaggatttaaagaggtgcaaagagatcacaagggagctttatgaggagaggggcctttttatccggatcaaggaacagggaagcaggctgttgtccccacttttatagaacccagcatcacagggcttattggaagctgtaaaatatctttttgttttcataatatctccatatccggcgcataatgaagggtatgaaaacactatcacaattacaattaaacctaaaacagctgcccctggatttctgcaaatgcggggtgacaggctggtgcctggaggttgtctttacctccatggaatccattttgcgccatgactggcgtctgatggggcagacctctctcttaatgtttcccatctacggatgcggagctcttttaggccccattggaactatcattgaccgctgggtaacccctgattccggattttctgcaaggaaagcggagctggctatccgccatggatttctttacatggtcctgatttttgtggcggaatattttgccggtacccttttgcggggcgggggaatgtgcccctgggattatacgggacgaaacaccaatattgacggactgatccgtctggactttgcacctctgtggtttgccacaggactgttgtttgaacaaattacaaaaaagaaaggcaggtagtattgtaattaaagtcaccattttatataatagatgaaatggaggactagaacaatgatacgttttattcttgtagcatcaacagtcattatttttttgattttaagcattccggtcctgatatttctgtggctgaccggaagaaaagaccgccgcctgcgggatgtgctgagtctggcagtggtccagtggattttccggatcctccttcgaatggccggcgtgaccattacggtcaagggaagggagaatattcccacagaccaggccgttttatatgtgggaaatcacagaagctattttgatattcttgtgggctatgtgacagttcccggcctgatgggctttgttgcaaaaaaggaaatggagaagatcccccttctttccgcctggatgaagtttgtaaactgcctgtttcttgacagaaagaatttaaaagaaggcttaaaaaccattctcacagggatcgaacaggtaaagcggggcgtttccgtctggattttcccggagggaaccaggaaccgggaggaaaatcttctggatctgctcccatttaaagaaggaagcattaaaattgcggaaaaaagcggctgcccggtggtaccggtggctataagcggaactgcggaggtgtttgaaggtcattttccattcatccgtccctcccaggtaaccattgaatatggtacgcccttttacacaaaggaactggagcctgaatttaagaaattccccggcgcctatgtggaaaatcagataaaggccatgctggaagcggagttaataaaccagggaaagcttaccggcagggcttgagcacacagacagataagataaaggaatgataaggcccatgaagacattggatttgcaggaaataagaaaacagcttgacggaatcgaccatgagatcgtatccttatttgaaaagcggatgaggcttagcggtgaggtggcggaatacaagattgagacaggcaagcaggtttatgacaaggaaagagaacagcagaagatcgaagccgtgaccggcatggtggaggcggacttccataagcaggcggtaagagagctgtttactcagatgatgaccattagccgccattttcagtacaagcttatggcggagcacgggctgagggcggagcatgatttccgccaggtaaaaagccttcctgtaaaacaggcacgggtggtgtatcagggagtggaaggcgcttacagccatgaggcttccataaaatatttcggagcggaagcacatatccgccatgtggattcctgggaggatgccatgaaagaggtggaggcgggaaacgcggattatgcggtgctgcccatagaaaactcctcggcaggagcggtgacccataattatgacctgctcataaaataccgcaattacattgtggcggaaaccttcctttccgtggaccatgccctgcttggtctttcggaggcaaaagaggatgagatccgcacggtattttcccacccccaggcccttatgcagtgctccgaatttttaaatgcccacagggactggaagcaggtcagcgtggaaaataccgctgtggcggctaaaaaggtccttgaggatggagatcaatcccaggcggctgtagccagtgaggtcgcagggaagctttatggcctgaaggttttaagaccttccataaaccacaataaaaacaacaccacccggttcatcatcctgtcaagagaacccgtttaccgggaagatgcgggaaagataagcatcagctttgagctgccccataaaagcggttctctgtataacatgcttagcaatttcatctataacggggtcaatatgatgatgatcgaatcaaggcctatattgggaagaaactgggaataccggtttttcatagatattgaggggaatttaagcgatgcctccattcagaatgccttaaagggaatctctgaagaggggagcaacatgagggttttgggaaattattaaaggcttgcaaatgttgtttcttatggttttacacaaggtgaaaggttgaaagaaacccgtctttcaaccttgagtttatgaacagcgtgccccgctttaccgggcatcagccggatatgcaggccatcggcttgattcatttaggaggcaaattatgaagtcccaggaattgattttgtaccgcaatttgaattatcgtgaactttttgacaaagttgccgggcttttaagcctgaaaccgggagagagaacagaaacaatgccggattcctatgcctgcgccggtcagctgatagagctggcggcttcctatggctttgaggggaatctctggcattgttttttagcattctgcctggcaaatgatgaaaacgcctacagtacctcctgtgagatcgtaggccccgtggaagggacgttaaatgaactggctgcccatgatttccggatcataaaggaattatttgaccatgacatccggaagctggacctcttaaacaacgggaaaggtatatggactgcactggccggctaccggagtgcagacggcagcagcaaggtctataataagaggatcagggatcagatcgttgccctggcaattgccctggaacaggctgaggatgaaacggtttttgcttcccaggtgacggagttttaccgcaggctgggagtggggaaattcggccttaataaggctttccgcgtagaagacacagaaggcgaacctcagatcctgcccatcaccagcattgagcatgttcatctggacgacatcatcggctaccagcttcaaaagcagaagctgatcgaaaatacggaggcattcttaaacgggcgggccgccaacaacgtcctgctgttcggggacagcggaaccggaaaatcctccagcattaaggctgtgctcaatgaatattatgacagaggacttcggatcatcgaggtctacaagcaccagttcaagtctctttcaaaagtccaggagcaggtaaaggaccggaattacaaattcatcatttacatggatgatttatcctttgaggatactgaactggaatataaatatttaaaagccatcattgaaggaggtcttgggaggaagccgggcaatgtgctgatctacgccacctccaaccggaggcatctcatacgggaaaaattcagtgataaaagggaactggatgatgatttacataataatgacaccgtccaggaaaagctttccctggtggcccgcttcggcgtgaccatttactttggttctccggataaaaaggagttccaggagatcgtaagacagctggctgcccgcagcgacatcaatatgcctttggaggaactgtatgcaaaagcgaatatatgggaattacatcacggaggcttatcaggaagaacggcaagccagtttattacacaccttttaggaaaaccggagtgaactatatgaaagctgcctggtgaatgggcagtaaggaggatcagtatggcaataagattatttgctgccattgatgttggatcgtttgaactggagcttggcatctatgagatttcccagaaggccgggatccagaaggtggatcatgtccgccatgtcattggccttggaagggacacttataaagacggaaagatcagctatgaacttgtggatgagatgtgccaggtcatcaaggattttgcctccatcatgcagtcctataaggtgatcggctaccgggcctatgccaccagcgccctgcgggaggccaaaaacagccggatcgtgctggaccagatccgggtgaggaccgggatcgaagtacgggtgatcagcaattccgagcagcgttttatcagttataaggccattgcttcaaaggatgcagaatttcataagatcatacaaaagggaaccgccatcgttgacgttggctttggaagcatgcaggtttccttgtttgacagggatgccctggtttccacccacaacctgatgcttggagtcttaagaatccgtgaaatgatgggaaatgtacaggtcgacaaccagatgcagaataccctgatcgaggaactggtggacaacgagctgtatactttccgaaaggtttatttaaaggacagggagatcaaaaacctcataggcatcggagaaagcatcctctatctttcccggggcagccggggaggaaagcctgtggagcgggtcacggctgaggaatttgcatttttctatgaaaagatcgtgggaatgtccctggaccagatccaggaccggttcggggtcaatgcggaatacgcttctctcttagtcccggcagccatcatctttaaacgcgtcctggaactgacaaaggcagagctgttctggatccccgggatccgcctctgcgacagcattgccgcagaatatgcagaagacaacaaggcggtgaaattcaatcatgatttttcagaggacattcttgcagcctcccgcaacatggcaaagcgttacaaatgccatagccctcatacggtggatatggaaaaatatgtgcttgatatctttgacagcatgaaaaaatatcacggaatgggaaaaagggaaaggcttcttttgcagatcgcggccatactccacgcctgcggtaagttcatcagcatgagaaatcccagcgagtccgcctaccacatcattatgtctacggagatcatcgggctgtcccatatggaacgggagatcattgccaatgcggtccgctataacggggtggaatttgattataaccggatccatttaaacgaagaggtgttccggaacacaaagggagaattccttcaggaggacagcatcatacttgtcggaaagctgacagccattttaaggctggcaaattccatggaccgaagccataaacagaagctgtcggaaagccgtatggccgttaaagacgggcagctggtggtgaccgtgccttatgagggcgacatcaccctggaagctgtggcatttcgccagaaagcggacttctttgaagagatattcggaataaggcccatattaaaacagaagaggaggttatcctgatggctgtcaacaatgaaatgatctataacaatcctgagaattatgtaaaccgtgaactgagctggatcgaatttaattaccgggtgctcagcgaagcaagagataagagccttcctctttttgaacggctgaagtttttaagcatcaccgcctctaatctggatgaattttatatggtccgggtggcttctctaaaggatatggtccatgccaaatatacgaagcctgacattgcaggcttagatcctaagtcccagcttgaaaagatcagcgggcggacccatgagctggtggccctccagtattccacctacaaccgttccctccttcctgcgttaaagcagaacgggcttcgggtggtacaaaaccatgaggatttaagcgtggaagagggaagatatgcggacagctattttgagcggaacgtgtatccggtgctgactcccatggcagtggattcctcccgtccctttcctttgatccgcaataaatccttaaacatcgcggccctccttcagaaaaaaagcggggaagaagagctggaatttgctacagtccaggtacccagtgttcttccaagaatcgtggaacttccatcccggaaaaaggaagaacgggcggtcattttgctggaacagatcattgaacggaacatcggcagcctgtttttaaattacaatgtcatcactgcccatcccttccgcattatgagaaatgcagaccttaccattgacgaagaggaagcggaagaccttttggaggagatccagaagcagcttaaaaaacgccagtggggcgaggccatccgccttgaagtggaggagaagatggataagcgcctgttaaaaatacttaaacgggaactgaacatcagctccggcgatatttttgagatcgcaggccctctggatctgacctttttaatgaagatgtacggactgaaaggctttgatcacttaaaggctgtcccttatgtgccgcagcaggttcccagactcatgaatgaggaagatatcttttccaacatccgcgagggagacattttgcttcaccacccttacgaaacctttgatcctgtggttaattttgtgaaaactgctgcaagtgaccggtcagttctggccatcaagcagaccctttacagggtcagcgggaattcccccattatcgctgctctggcggaagcggccgacaacggaaagcaggtatcggtcctggtggaattaaaggcccgctttgacgaggaaaacaatatcaactgggcaaaaaagctggaaaagtccggctgccacgtgatttacgggctggtaggcttaaagacccacagcaagatcaccctggtggtgcgcagggaggaagacgggatccgccgctatgtccatttaggcacaggaaactacaacgattccacagcaaagctttacacggacatgggtcttatgacctgcaatccccagatcggagaggacgcaactgccgtgttcaacatgctgtcaggttattccgagccccttcactggaataaactgattctggctcccatatggctgcgggccaggttcctaaggatgatccgcagggaagcgagaaatgcggaaaacgggaaaacagctcatatcatggcaaagatgaattccctctgtgacaaggagatcatagcagctctttatgaagcctcctgcgcgggggtaaagatccagctgatcgtccggggcatatgcagcttaaaagcaggggttccggggctaagtgaaaatataacggttcattccattgtgggaaatttcctggagcacgcccggatcttttattttgaaaacgacaacagtccggagctttatatgggcagtgccgactggatgccgagaaacttagaccggagggtggagatcatgtttccggtggaggatgagaccctggtggagcagatcctccatgtccttaaggtacagtttcaggataacgtgaaggcccacattctacagccctccgggacctatgaaaagccagataaaaggggcaaggtcctggtcaacagccaggagcagttctgcgaagaggcgatcagaaacgtaaaggaagaacttggtaaattaaacccaataggcagccgtgtattcattcctacggagagccaggaggaataagagaattccatttaattaccgaattatagcttttttgtaagaaaatagtaaggcaaagatacctttcttgtggtaaaatggataagagtctaagcggtgcatgcaccgctgaaccttatatatacatacgacaagggaggtatttttcatgtccgaaacaataagcattctggttgtggatgatgagaaagaaattgcggagctggtggagatctatttggtcagtgatggatataaagtatacaaagcaaataatgcggaagagggactgggaattctggaaaagaaccagatccatctggtgcttttagacatcatgatgccaggaatggatggcctgcagatgtgcaagaagatacgggagactaataacattcccatcatcatgctcagtgccaagtctacggatctggacaaaatattgggtcttggaaccggagctgatgattacgtgacaaagccgtttaaccccctggagctgacggcacgggtaaaatcccagctgcgccgttatacccagttaaaccccaacagcgcggtgaacgaggcggttaagaatgaaattgcaatcagagggctgaccattaacaaggataaccacaaggtgactgtttatggggaagagatcaagctcacccccattgagtttgatatcctttatttgctggcttccaatccgggaagggtgttcagcacggatgagatttttgaaaaggtttggaacgaaaaggtttatgaggccaataacacggtaatggtacatatcagacgcctgcggggcaagatgaaagaagataccagacagaacaagatcatcaccactgtgtggggggtaggatacaaaattgaaaaatgatatcaatcgccgtttccatacccgggtcattgccaatattttttacagcgcagtggtcacggtcctgatcgagatatttctggtaaccaacgtatctttggtagcctcctacatgagaaacacccaaagggacaatgcatttgtggaaatgctcacttcctttgacgtggtggtgatcctgatttatgtggttttcggaataggaatattcacggtcaccttccttcttctccaggaaaagtccatgcgttacatcagccggatttctgatgccatgcggagcatttccgagggagatttaaacattatggtagacattgagggagatgatgagttctccgtcatggctgccagtttaaacaagatggtgggagatttgagaagcctcatggataaggaacgggaggcagagcggaccaaaaatgagctgattaccaacattgcccacgacttaaggacgcccttgacctccatcatcgggtatctggaacttttatccggagaaacaaagcttgatccggaagtccagaaaaattacatagggattgcatacgtgaagacaaagcggctggaaaagctgatcgaagatttattcggatttacaaagctgaactatggaaagatctccatgcacgtgtccaaggtggacgtggtgaagctcttgagtcagcttctggaggaattttatcccagttttgtggataagaacctttcttatgagcttcaaagcaatgtccccgcccaggtcatttcggcggatggcaaccttttagcccgtctgtttgacaatctgattaacaacgccatcaaatacggagcggatggaaagcgcatcctggtaaaggttcacggaagcgaggaactggtcacgatccaggtgatcaattatggttacgtgattcctgaggaggagctgcccctcattttcaacaagttttaccgggtggagcagtcccgctccaccaatacgggaggaaccggtctggggcttgccattgcaaagaatattgtggatatgcacggcggcaccattgaagtgaccagcgacttatctggtacggtatttacggtaaagcttttagtggattttgatattaataaagagaactttggaaagatagggtgacagagaatgaaattcagacaaatatccctgatttgtgccattgcggtcaccatagcaggcagcgtaatgctgcctgctttcggcatggcatatgaaacatcggctgggatggaggcggggaatccccccacagacggaaattatgctgcctccaattccggtgtttccatggatgtttcctacggctatgaaggaaatgcaaaaagcggacgttacgtgccggtaaatattacattaagcagccagctggattccggctttcatgggacggtccaggctatggcaatggaatctgattatgacatttaccaatatgaatacccggtttccttaggtgcttttgaatcggcggaggagtccctggatatccccgtgggaagggcagatgtcctttttgtaaagcttctggactcccagggaagagaactgatccgtaaacgcttaaagatgaatgtcacggcggatattgcggagctgtttgtgggagtgctgtcggatgagccggaaaccatgtcctatatggagggcgttggagtaaattacagctctgtcaggatcaagacctttgaaatggacggatcgaagatgccagataatgtcatcggcctggatcttcttgatgtgctggtgattacggattatgatacaaaaaggctgtcagaagaccaggtatctgccatctggggatgggtgaaggaaggggaatccttcttcttggaaccggggccagggcagatgacaccctttatgccttccgttccgatatcctggaggaggattatgctccgccttcggaaaaatccgtggacatgggagtggaatattcttccaatggcccgggagattcctttatgaatctggtttgcgcggatgtttccctaaaaggaggcaccggagtgctgtccaatgatgaattcccggtcctcacatccgtgtcaaagggaaaaggaaaggtgggagtggccgcctatgattttgtggacatcgcctccttttgccaggtccagcgctcctatgtggataagctttttacggcgcttttgggagaagccaagttaaatgatttgtcctcatacctttacagcggcaattccgcccagttctggtccgtccagaatatgttaaataccggagacgtggataagctgcctgacttattcctttatgcagcggtgattctgggatatattcttctggtaggccccgggctttacttattcttaaaaaagcaggaacggagaagattttaccggacaggagttgcagcagtttcactgttctttgctgcggtagtatatttaatgggaatgggaaccagatttaaggacaccttctttacctatgccaccattctggataccaggtcagactatgtggatgaatacacctatctcaacatgaggactccttacaacaaggcatataccattgccctggacccgtcctatgacttactccccatcaccagaagcagctcctatgaaatgaagccggttcccagatttatgggaaatgaagattacaaggtgaagatatcctatggggaaaatgacaccagggtttctgttcagaatgcggcggcctttactccgaaatattattctctgaggaaacggactcccaataccgatcatcagggcctgacaggggacattactttgtttgggggaaaggtatacggcaccgtgaccaatgaatatcccttccaggtagaaaaggtggggatcctgatgtacgggaaaatggtggtcattgaagagctgaagccgggagagaccatgaacttagaggggcttcctgtgatcaattaccccattaataattcctttctggtatcagcccgtgtgacgggaagctaccagtatcaaaaagcagatattgaagaccctgcttacatgctggccctgtcaaggaccaatattttaagcttttacctggataaatattcctcattttataatcccgaggccaggatcgtggccttcagcaaggaccagtcagccagtcagttccttgccaggggaagttatgagacttacggcatgtccatgttcacatccaccattaatgtgaatacaaagaaaagcggagagacctcccgttctgccctcatgaaaacgcctacagtggtaagcgggcagtattatgcggattccaatgccatttacggcatagacccggtagctttggagtatttccttggaaatgatttagaggtggaaacactgacctttgaaaacccttccgatgagtttttaaacagcgaaagcttttactacaccactatttttaagggaaacgtctatttctacaatcatgacacgggaaattacgatgccatggaccctggcaaaggggtttataaagcctgggagctcaccccttatctgtctcccggcaacaccctgaccgtaaaatatgtatgtgacaatacggctgagaacaactggtatgtgactctgcccatgctgactgtgacaggaagggataaataatgttagatattaaggatttacggaaaaaatttggaaagttccatgcgttaaacggtctggacctacatattccacagggttcactttatggattcgtaggacctaacggagcaggaaagaccaccaccatcaagatcatgacagggcttcttttcgctgacagcgggcaggtgatgattgacggggtggatgtgtccaggggcttaaatgagttaaagctgaagatcggctatgtgccggattttttcggggtttatgacaatttaaaggtcaatgaatacatggaattctttgcctcctgttatgggagcgacggcttgaaggccaggacccggtacatgactcttttggagcaggtgggcctggaggataaggtgaatttttacgtggacagcttgtcaagagggatgaaacagcggctctgcctggcaagggctttgatccacgatccccttttgctggtccttgacgaaccggcctctgggctggacccgagaaccaggtttgaatttaaagaaattttaaaggaattaaaagagcagggaaagaccatattaataagctcccatgttctctctgagctttccgaactgtgtacggatatcgggatcattgaccagggaaaaatggtcttaagcggaagtatggaggagatcctgcgcagggtcaacgcttccaatcctctgatcatttctgttcttggaaataaggaaaaggcgctgaccatcttaaagagccagccctgcgtccagaccatagcggtaaaagacgaggacatccgggtgaatttcatcggagataatcaggatgaggcccttcttttgcagcaattggtggatgccgacgtgcttgtgcatggattttacagggaacagggaagcttagaatccctgttcatgcagatcacggatcatgataaagaaaaggcggtgcttgtacatgaaattgaatccggtttataagagggaaacaatggtcagctccagaagcttccgtctggcactgatcctggccctttttaataccatcctggctctggtggtcctgcttaacatgtattccgtggtggagcgggttaagctgacggcggagattcagtattcttcctttaccaatttgtacgtgttcgtggctgcggtggaatttgtgatgctgatgttcatcatgcctgccctgaccgcaggaggcataagcggggaaagggaacgccagacccttgaccttcttcttaccaccaccttaaagccatgggaaatcatatgggggaagctcacctcctcctttggcaccatgttcatcctgatcatgtccagttttccccttctggcggtgtcctttgtttatgggggagtgatggtttatgacgtgcttcttctgcttttgtgttatttagcggtggcccttctctgcggaagtatgggaatctgtttttcttccctttttaaacggtccaccatcgccactgtagtcagctatggagttttggtcctcattgccgcaggcacctatgcaatcaatgcctttgtcttatccatggcccgtatgaatatgagcagtgcctatgccatgtccgtgggcggcatggctgatcagaccaattccggcgcattcctctatctgctcctggtaaacccggcggccaccttttatgcaatgatcaacggccagacaggggataatcaggtggtgaggagcttaaacagctggtttggccctcacccggataactttatcatggaaaactgggtggttttaagcattttcattcagttggcactggctgctgtgttcatgttcatcgccgtaatggccatcagcccgtccaaagggaaaaagataagaaaaataaaatgacaggaggtttttatgcttacgatcggatgtcatctgtcttcctcaaaaggctattttgccatggggaaggaggctgtgaagattgatgccaatacctttcagtttttcaccagaaatcccagagggaccagggccaaggccatgaatccggaggatgtaaaccgttacttagactttgccagggaccacgggattgagaggattctggctcatgctccctataccttaaatgcctgctctcccaatgaagggcttcgttcccttgccagagacaccatgaaggatgatctggaccggatggaatacactcccggaaactgctataatttccacccgggaagccatgtgggacagggaacagaagctggcatatgctttatttcggatatgcttaatcaggttctgacgccgcagcaacataccaccgtgcttttggaaacaatgtccggaaagggcagcgaggtgggaagggaatttgaagagcttaaggagatcctggaccgggtggagcaaaaagaccatatgggagtctgcctggatacatgccacgtatgggatggggctatgacattgtgggggatttagacggggtcttaaaccggtttgaccgggtcatcggacttcataaattgaaggccattcatttgaatgacagccagaaccctctgggagcccacaaggaccgccatgcaaagatcggtgaaggctttataggctttgaggctctaaaacggatcacggtccatccggccttaaaggaccttcccttttatttagaaacacccaatgacctttccggctatgccaaagaaattgccatgatgagggaatctgtatagccaaccgtttaatggtgtagtataatgagcggaagggagcgaagatgagcttgctcatgggcgcgagcggcgaatgacgatcaggaaccgcaggttcatgatatggtgagcgaaagggagcgaagatgagcttgctcatggttgcgagggttgaatggcgatcaggaaccgggaaaataatattgttgaggaggaaataacatgggaattgttaaggcgcttactaccgcagtaggaggttcactggcagaccagtggcttgaagtgatagaagcaggcaatatgggagatcagaccgtattcaccagcggagtgaagatccggaagggatccaatacaaaaagcacagaatatacggtatctgatggttccgtgattcatgtttaccccaatcagtttatgattttggtcgatggcggaaaggtaattgattacaccggagaaccaggttattttaccgtgaaaaattcttcccttccatccctctttaacggtcagtttgatgaggcaataaaggaatcctttgaccggatccgcttcggcggccagacacccacttcccagagggtgtatttcatcaatttacaggagattaaagggatcaagttcggtacgcccaatcccatcaactattttgatcagttttataatgcggagctgtttttgcgggcccacggaacctattccatcaaggtgacagaccctctgttattctatggggaagccataccgaaaaatgcttcccgggtcgaggtggatgacatcaatgcccagtatttatctgagtttttagaggctcttcagtcatcgatcaaccagatgtccgccgatggcatccggatctcttatgtagcttcaaaaggaagggaactgggacagtatatggcgggtgtccttgatgaccagtggaaggaccagagaggaattgagatccagtccgtgggaatcgccagtatttcctatgatgaggaatcaaagaaactgatccagatgcgcaaccagggtgccatgcttggcgatcccggggtcagggagggctatgtgcagggagcagtggccagaggtattgaagcggcaggaagcaatgccaatggttccatggcaggatttatgggaatgaacatgggaatgaacactggcggcggctttatgggagcagcttcaagtgccaattatcagcagatgcagatgaaccgggcccagcaggataattccatggagcggactccggtaagcggagcgggtaagaccgaaagccctttggaaagcccatggacctgcggctgcggaagtgtgaatacaggaaagttctgtccggaatgcggaaatccaaagccgtcaggaacatggacctgtgaatgtaaaactgtaaacaatggcagattttgttcggagtgtggaaaaccaagaccatgagtgagatcataagctataaatgtccaaattgcggcgggccgcttatctttgatccgaaaaagcagaagtatgcttgtgaatactgcttatcagaattcaaccagaaagaaacagagagcggggagccgcaggagcctaagtcagaaaagaaaagcagggagccggaggcacccaaggcaaagaaacagggcggagagcctgtcctttatgcctgcccaagctgcggcgccgaaatcgtgacggatgagaccactgcagcgaccttctgctactattgccataacccggtgatcttatcgggcaggctgtccggagaattccatccggactatgtggttccatttgcaatggaaaagaagcgggcagtggaaatctttgagcaatggatgaaaaagaaacggtttgttccaaaggctttttacagtgaagaccagattgagaagatttccggcgtatattttccttacatgctttacagctgccgggcggagggaagcttaaatgcaaaagcggaccgtctgagggtatgggtgagcggtgaccgccgctatacggaaactcagacctatgatgtccgcagggaaggttctatgcccgtgaaattcgtgccccgtaatgccctcaaaaagtccaaccgggagctggtggagggcgtgctgccttttgaaacggagaaaatgaagcccttttccatgggatatctttccggctttgtggcagaacggcgggacatgggagagcaggaattctctgaggaagtaaaatcagaggtgcgcctgtttgccgagcagtctttaaaaaacagcattacctcctatgattctgtgagggttcagaatcaatccatccacctggaggatgaacgatgggagtatgcacttttgcctgtgtggacccttacctaccacgatggggcaaaggaccagatgtattattttacagtgaatgggcagaccggtaaggtatgcggcaagcttcctgtggaccggaacaaactgatgcttctgtttatggaaatattcctgcccgtatttcttgccatgttgattgtggggtatctgatatgacgaaaacaaagggactgttccttgggataagccgggtaaccgttttactgtttatggttcttctgtttctgatcgttctttccggcggcatgaaagcttttgccgaaagccagagtccgggaggtgctttaagtgaaaaacgggtatatgatgatgccggactattttcccaggaagaaatagaaacatttgaaactcagatccaggcgatgagaaaagatatgaatatggatgtggtgattacaaccacagaccaggcaggtggaaagtcggccggacaatatgcggaggatttctacataagaggagcctatggagttgggaaggattacagcggggtattgttcctgattgacatggataaccgggagctttacatccttccggtaggaaagatgaaccgctttttaacggataagcgctggaattccattctggattccgcttatgacgagataagcaatcagaattacggagcctgtgccgggagctttctggatggtgtgaccaaatattataaggccggaattccaggaggacagtataattatgataaagagacaggaaaaataagtgtttaccgcagcatccggtggtatgaggcagctttagcagcccttatcgggcttattgcggcggcttcagcctgcgggggagtaaccagccggtattccatgaaaaaggagagaggcggggctaagaactcactgatggcctatcgtgcaaactgtcagttccggtattcggaccagttcgaccatctggtgaacaaaaccgtgacctatatgatcattccccggaatcaggggaatacaggccggggcggaggcggtttttcctccggcggcaggagtactacccatacttcctccggacgcactatgggaggcggaggtcggaaattttaattaaataatcatgattccatgtcaaaagcgatgctcctgtttttttaaccgaatcaaaattctaatatggatgtctaatgaacgcagcgtgacgctgcgtttattttcctctattcagctagggtctatatactccgtaacagcggtttccaacggttaccacaacaagtccgttgaaaccttcctcacatatcacgtcagatagaccgggatcggcatgtccagggagagggaatcctccgtaacaacacagtcatatgctaaaatatggacgcctgcctccttcgccctttttaacgcttccgcaaattccggatgcgtttttttatttggcgtaaatgcctccatctctttcatctggatgacaaacaggatataagcttcatatccttccctgtgggcattaataagctcctccatgtgttttactccccgcaccgtcggcgcatcaggaaacatggcaaggcctttttcttccagggtgacacccttaacctccatgaatgcagggattttctgcccatgggtttcccgttttccaggcagaactgcctgaaaagccagatcgaaccgtgactggtcgtaggtaacttcccgtctgatgtcctttatgaccggacggaaaagggaaagcgtatcctccgcctggtgaaaaggcaggggagaattttcccgggaggattgcagccactcgtacgctgcctgattgggggcctgggaatccatattgatgaggagcggcccgcccctttcccgttccttccatacgccgatcaaagagtattctgtccttcttccaagggccgcggcctctggatgaaactgcaccagcaccttaacgccggggatgagtaactcccggcagcgccctgtatttttaacatgacagatcacttccgcttctccatacccctcttttgaaatcaggacgtgggcaataaaacggttaggccggcttataaagatccctgtcagcatgtgttcgtatctcaatgaagctgtctcctttctgtatccatggttgtatcttaccatatagagaataaaaatggaacccttgtgtctctggtgtgaatacattcgtccgttagatggaaactttttgcccttttttcttgcgcccttaaagaaagtgtgctacaatgctggcaaggtttttgatccattgatattatgagagagcaggaaaggaataacataccatggaaatatcctatcaaagtaccaggggcaaagaggccggcctgacagcttcccaggcaatcttaaaagggctggcggaagacggcggcctgttcatgccgtgttttatcccaaagcttgacaaatccatgaaggagctgtcggaaatgacatatcaggagacagcctatgaggttatgaagctgtaccttacggattacacagaagaggagttaaagagctgtattgaacgggcttatgacagcaaattcgatacagaggagattgcgcctcttgccaaggctgacggagcctattatctggaattatatcatggaagcaccattgcatttaaagatatggccctttccattctccctcacctgatgactgctgctgcaaaaaagaatcaggtgaaaaataaaatcgtgatccttaccgctacctccggtgacacaggaaaggccgctatggctggttttgccgatgtggaagggacggaaatcatcgtgttctatccaaaggatggagtgagccgtgttcaggaacttcagatggtaacccagaaaggggaaaatacccatgtggccgccattcatggaaattttgatgacgctcagacaggtgtcaaaaggatattcggagataaggagtttgcccgcaaactggatgaaaagggctttcagctgtcttccgctaactccattaacatcggcaggctggttccccaggtggtgtattatgtctatgcctatgcaaagctccttgcctgtgaagagatttctgacagagaagagatcaatgttaccgtgcctactggaaactttggaaacattctggccgcctatttggcaaagcagatgggggttcccattaagacccttatctgtgcctccaatgaaaataaggttctttatgatttcttccagaccgggacttatgacaggaaccgggactttattctcaccagttctccgtccatggatattttaatatccagcaacttagagcgcctgatttatttaagtgccggatgtgatgcagaggccaatgcggttcttatgaaggaactgggtgataaaggcagctatacagtaaccaccggtatgaagcactttatggaagattttatgggaggttttgcaggagaagaggaaaccggggcagttattaagaaggtttttgaggataccggctatctgatcgatccccataccggtgtggctgcatgtgtatatgaccaatacaaggcggaaacaaaggatcaggcaaagaatatcattgcttccacggcaagcccctataaattctcaagaagcgttctggaagccattgaagggaagcaggaagagcctgatgaattccggatcatcgatcatctggcagagttatccggggttcccgttcctcaggcagtggaagaaatccgcaccgcaccggtacgccatagtaccgaatgcgatggggataagatgaaggaagcagtggaaagctttttaagctaattcatgttccggttggcataccggcaccattttccgcttaagacccgggtggagaagaaaatggcgcgcaccagccagtcaatggtcatggcgatccagattcccatgaggcccagaccgaaatacaggctcagtacgtaggcaaggacgatccggcagatccacatggaacagatggacactgtcatggtgaaacggacgtcattggcggcgcgcaggccgttggttaagcaaaaggacaggggatggatcagcatgcagcagatgctgtggtaaagcatcagcttgacggccagggcgctggtctcgccggataaatggaacatgttggatattggcttcaaaaatggtatgatggaaaggtttaataccagcagccagatatatgccgtttttaagagctttcccatatatttccgggcctgtttcagttctcccgccccaatgcactgcccaactaccgttactaaggcgatgcctatggcgttggccggtatggtttccaggccgcatatggtgctggctaccgcatttgcagcaatagccatggtgccgaagctggcggtcagactggacaggagaagctttccaagctggaaaatgctgttctccaggccgtttggtatgccgatatagaggatctggcgcagcatggtcttgtcaacctttaagcggaactctattgggaaatggttctgcttccggagaaggatcaccatgaccactgcagataagattctggaaaacagggtggaaagcccggcgcctgccacacccatttgaaagccgtagatcagcagggcgtttcccgcaatattgcagatgttggcggccagagagacctgcatggagaccttggagtttccggaagttctgaaaagggctgcgctgctgttataaaatgccaggaacggataggaaagggaggatatgtagaaatagacccgtccgttttccataacctcgtgaccgatattgccgtatatgagccttaacagctgctggttaaagataagggtcactgccataagaaaaatggaaagccctcctatggccaggaatagctggcctgcggccctggcaacgcttttttcatcctttctgccgatgtactgggccgttacgacagaacctccggcagccattgccccgaacaatccgatcaaaaggacgtttatggtgtccacgatggatatgcctgacacggcttcctctccgcaggaggccaccatgatggtatcggccattcccataaaaacagccagtatctgttccaccacaaggggaaaaatcaactggcgcagctgctttccagaaaacaaatccggctttttctggtgttccagcatttctgtggtttcagagtccagggggtggaaaatgccctttctcatcattcgtttcataaaaaatctcctatcatgtatttgtaacttatatttattataaagcaaagtacggatgaaagcaaaatgtaacttcgttataaaaatgacaatctggaaaaattattctttccaaataaggtaagatggtatataataaaaaggatataagagaaaaatttaaaatggaggtttgtgatatgttagtttcagcaaaagaaatgcttgaaaaggcaagagacggaaagtatgcagttggacagttcaacatcaacaaccttgagtggacgaaagctgttttacagacagccgaagagctgaaatccccggttattctgggtgtttccgaaggtgctggcaaatacatgacaggctataagaccgtaactgctatggtaaaggccatgatcgaagaattaaatattacagttcccgtagcccttcatctggaccatggttcctatgacggctgctataagtgcattgaagctggattttcttccatcatgttcgatggttcccattatcccattgctgagaatgtggaaaagaccacggagcttgtgaaggtctgcgctgaaaaaggactctccattgaagcagaagttggttccatcggcggcgaggaagacggcgttgtgggtatgggcgaatgcgcagatcctgatgagtgcaagcaggtagcagacttaggcgtgaccatgctggcagcaggaatcggcaatattcacggaaagtatcctgcaaactgggcaggtttaagctttgatacactggctgccataaaggataaagtaggggacatgcctctggtgcttcacggcgggacaggcattccggaagatcagatcaagaaggctatcagccttggcgttgcaaagatcaatgtaaatacagagtgtcagctttcctttgcagatgctacccgtaagtatattgaggctggcaaggatttggaaggcaagggctttgatccacgtaaacttttggccccaggaactgaggcaattaaagccactgtaaaagaaaagatggaactatttggttcagttggaaaagcttaaggaaaatattttttaaaaagtacttgattttttacggaaaatggtttaatttaatttaagaacgatggcgttctccttataccgggagggcgccttttctgatgtatgcgcatattcagatcgtgaggagactaaaaagcagtttgacttatcgaaatatgggaggatggaaaatttatgagcgaagttataaatgtagccgagctgttcggtaggaatgtatttaacgaagcagtaatgagagaacgtttaccaaagtctgttttcaaaaaaataaagaaaaccattgaggatggctcagagctggatccttcgattgccgacgtggtagcccatgccatgaaggactgggccattgaaagaggggcaacccactacacccactggtttcagccccttacgggcattaccgctgaaaagcatgattccttcatttcttcacctacggccgaaggaaaggtgatcatggaattttccggtaaagagctggtaaaaggcgagccggatgcttcttcttttccgtccggcggcttaagggcaacctttgaggcaaggggctataccgcctgggactgcacttcaccggcatttttaagggaagatgccatcggcgttaccctttgcattcctactgctttctgctcttatacgggagaagctcttgacaaaaagacacctctcttaagatccatggaggctgttgacgagcaggcattaagaatcttaaaattattcggaaataccacctccaagagagtgaccccttccgtaggagccgagcaggaatatttcctggttgaccatgaaaagtatttgcagagaaaagatttaatttatgccggacgcaccctgttcggtgcaatgcctcctaagggacaggagttggaggatcattacttcggttccatccgtgagaggatcgcggcttatatgaaggaagtaaatgaagagctttggaagctgggagtaccggcaaagacccagcataatgaagttgctcctgcccagcatgagctggctcccatatttgaacaggcaaacgtggctgttgaccataaccagttggtaatggagtccttaaaaaaggtggcaggccgtcatggattaaactgcctgcttcatgaaaagccctttgcaggagtcaatggctccggtaagcataataactggtccctgactacagatgacgggatcaacttattaaatcccggagaaactcctcacgagaacattcagttccttttggttctgtcctgtatcttaaaggcggttgacaaacatgcggatctgcttcgtgaatctgcagctgatgtaggaaatgaccacaggcttggagcaaatgaagcacctcctgccattatctccgtgtttattggagagcagttagaggatgtagtggatcagctttgcagcacaggagaggctacccgttccaaggcaggcggtaccttaaagacaggagtaagaacacttcctgatttattcaaggatgcaacggacagaaacaggacctccccctttgcatttaccggcaataaattcgagttccgcatggtgggttcctctgattccatttcttctcccaatgtggttttaaacaccattacggctgaagcatttaaggaagcagcagatatccttgagaaggcggctgattttgacacagcagtccatgacatgatcaaagagcagctgtgttcccatagaagaatcattttcaacggcaacggttattccgatgcctgggtggaagaggctgaaagaagaggccttccaaaccttaaatcaatggtggaagccattcctgccttaacaacggaggcttccgtgaaaatgtttgaggaattcaaggtattcacaaaggctgaactggaatccagggttgagattgaatatgaggcctacagcaaggccattaacattgaggcaaagaccatgattgatatggccggaaagcagatcatcccggcggccgtgaaatacgcctccctgctggccgattcccttggaaaggtaaaggcagcttgtccggtagctgatatcagcgttcaggaagagcttcttatcgaagtgagcgccctcctttccgacatgaaggtggctctggccggtttgaatgatgttgctgagaaatgtgcggcagtcgaaggcaacaaggagcaggcaactgcttaccatgatgaggccgtgcctgccatggcagccctccgggcgcctgcagataagctggagatgatggtagacaaagaattatggccaatgccaagctatggagatctgatctttgaagtgtagcagcaggctgtgaaataagagaggtgatgcccttccggcggtcaatgaccgccggaagggcatcaccttattatagttcccagtaagtgggctgcatgttcttaaaagtgcagaactgtttgaatcctatatcttttaacatcccttttacttcctgaatgtgatttcccaaatgctcaattttatgactatctgagccaatggtaaggatggttccgcctaactcaagatatcgtttcaggatctccctggagggtgttaagtcctttaggccatatctgaaacaggaggtgttcacttcaactccttttttgtcggcaatgacctggcggagtattttttccaccgtatccatgattttgctgtccggatattccccataggtgtcataccgtttgatcatatccagatggccaagaacggaatagttcttatatgcctgcacaacttcataaatggcctgataataagcggtttgaaattccttctggctctttccctcctggaactggtaattccagaactctttatcatccacctgatgattgctcagaatgacgaaatcaaaggaataggcttcaaaatccttttggaaaagggggatagtgtgagtctgaaccccgaactcaatccctgtttttatagttaattttcccttgtacttttctttcatttcttttatttctttaaaataactttcataatcacaatttaaattggtttttactccatgatccacatgttctgtaaatgcaatttcatcaaatcccaaaagaaccgccctttgtattatttcttccatgggacactctgaatcatcgctgtaataagagtgcacatgatagtctgacagcatgccttgttcctccatccttattttcgtgtacaaatgatttttctttcaaccttctttgccggtttatgatttatatgatataatgataatgcactgagacccacttatctaacacaattatttttatttattataacaatcgtatttagagaaggtgaagggaattttatgatagataccaatgtcatgcaggatgcctctgaaattgtccgttatgaccagatggggattccgctttatatccagagggataagctgtcagattatcctgattggaaggccctttgccactggcatgaagacttagaattcatccgcattttaaaaggtcagatgaactaccatgtaaatggaaaaagggtattgcttaaaaagaatgactgccttatggtcaatgccagacagatgcactacggttattcctgcaatcggcaggactgtgattttatctgtatcctgttccacccccagttatttacaggaaataaactgctttttcaaaagtacatagccccgattatggaaaaccaaggcatggaatatatttactttgacggtttaagcagcgagggaagggagacggcggcccagcttgatcagatttatttttcaaaggagcaggcctccattgcctacgagatcgaggtaatagggatcatgctcgctttatggaaacggctttgtgagcggtgtgaagccatatccccggaaacagccggacaggctggttccgatatttcagcccaaaaggatatggtgtcttatatttaccagcattatacggaaaagctgaccttatctgatattgcggcggcgggaagcatatgcaggagcaaatgctgcatcattttcaaacgttatctgcagcagtcacccattgattttctaaattcatacaggctggaggtgagccggggccttttaaaggactcagctgccagcatcacccaggtcgcccttacatgcggctttaatcatctcagctattattccaagctatttttaagaagctatggctgtacgcccagcgaatacaggaacttacattccttgtgaaaggattgtaaaaagaaaaataaagaaagaagaaggtaaattaccatggaaaccatgtcatatgtcatatcaatgttagaaaaaatcgttaatattccaagccccagcggttataccagggaagtcatgcaggcggttgaggaggaagctgaaaaatttggctgttcctttgcctataacaggaaaggaggcctgatcattgaagttccagggcagaaacaggaggttttaggcttatccgcccatgtggatactttaggggcaatggtccgctccatcaccccggcagggatgctcacccttgtgccggttggaggctatatgatggagaccatcgaagggatgtactgtaaaattcacaccaggaccgggaaaacctacaccgggaccatccttacaaaagagccatctgtccacacctatgacaatgccaggaccctggagagaaaggccagaaatatggagatacgcctggatgaattggctgaaagcgctgatgatgtaaaggaccttgaaatagctcctggagattacatcagctttgaccccatgtttgtccatacgaaaagcgggttcatcaagtcccgccacttggatgacaaggcctccgtggccattcttctgggagtgttaaaggatatttttaagtccgggcacaagccggaaaggaccttaaaaatagtgatcagcaattacgaagaggttgggtttggcgccagctggatcccggaagacatagaggaatttcttgcagtggacatgggggccctgggggatgacttaaccgggaatgaaagaaaggtatccatctgcgcccaggattccaccggtccttatgactatgaaatgacgaaccgcctcatcgccgtcgcaaaggagaggggcctggattatgcggtggatgtatttcctcattacggctctgatgtgggggccgccatgaagggagggcataatatccggggggcattgatcgggccgggagtccatgcttcccatgggacggaacggacccatgagaaaggaatggaacagaccttaaagctgattgaaggatttatcggccttccatttgacggcagatcttagggctttgatcttcgcctttcgcctggtccataattttaaaataacgccacagggtagaacggctgactccaagctctttggcaagcgcgcctttgtgaccctggcagcagcggtctaaggtgagcagctcttcaaatgtaaccagtctgtggttgatcataaagccttttttctcggcggagaccgcaaagtctgatatggaaaaatctttctgggtgaggtgtgcgtaataagcactgtcatccagatttttctttataaaatcaagagtcagctcctcaggtgcaaaagaggtaaaacgccggcaaaggcttttcagctggcttaaattacctggccagaaataagattccagcaattcttccgcaccagaggggaaaggaatgctttcctgcaacgccgggccgggtgtttcctgtctgtatgctttcgccatttcggaaaaaagcgggcagatgtcacttttgcgttggcgcagcgcaggcaaaggaagtaaaaaggtgttcaggctgtaatataatctgtcaggaagagggccgggcaggctttgggtggaaccggcaatgatgcggacatccagatcccggcaagtgtgattaggaaggattatggtatgtgtttccagaagcccggctaaaagggcggatatgggatcggaaatctgttcgatgtcacgaatatacaacgttccccggttagcggacaaaaaatcttccaaggacagaaggcggctgtcccggatgagaaagagttcaccgctcctggaacttaaatcatgaatccatttggcaaatacagtttttcctgtgccgctttcgcctacgatcagcacaggagcgtcctgtggcgcataccgccttgccatggagcaggctgtcaggaaagcgggatgttttcccgccgggcgtcctttagagaatttttcggccggctgtctgggggaggttccgtccgagtccgtcccggctgttgcagaaacgccggaatccggcagggatcttacgatgataattacgcctttgctccgctctttgatcatgaccggatgaaagtcaagaatgcattccgcacctctgatgacagccgcgtgcccttttatttcatcgccccgaagcaggatccggttgatgatggccgtctctgcgccggaaaacagcgtggaataaggtttccctgtaatttcctcttcggaataccggagcaggccttgggcagaggaattaaacagattgatcctgcccttttcattgattccgatgattccgtcggaaatggcattcatcatgatgattcgttcctgaagcttttttctctggagcataactcccttttgcacttccagggcccgttcgtaggcctcttttaaggattccatggagctttccaaaaggacgcatttcagtccgtttttctcagccagttcctgggtgtaaacacctccgatcactatgtttatgtgttcccttttggcgcggagaatgttgtcatagatgtcctggctgttttctacgctgtagaggcggattttccggtgaaggatatccagaaagccgctgacagattgtatgacgtcttccatcccaatgtaggcgatctgagaatcctcttccccatatagttccgtggctgtggtgatggagcggatcaattcagagtccttgatggggatcgttacaatgggaaccggaatatgggaggcctttaagagtttggcggtgtttccccgggcgatgatcacgtccgtgcccgctggaagatggcggcgtgcatattctacagcctgttccatataggtatttacgatggaaagggattccggaaaggcaagtttcttttgaagctgcttccctaagttggagatggagtctccggaggcgattaaaacgatattggtcataaaatactcctttcatggccgttcttgtgatgtttcaattatgtttctattataaaacaataaaacgtaattgcaataaaaatgaaacaaaataaacaagaaaattacaaaaacttgccatatattttgacaaagtttacaatggtcatgaaataaaacaaaggaggggaaatatgtttcctattgatcaaaacgaaaatttcacattttcaaaagcagagttttataatttccatccgataccggtgaaaaagccgtggcgcgacgcaaccggcggatttggaagttatgtgcctcttcaggggtggatacggatttatgacctggaaggatattacggagaaagcttctgttctctgggaattgtcaataatattctgccgcttatcctgacgggagaaacccgcagctacagccagtggtatgaatatatttactggaaaatgcgaaattttggtttccagagcgggcagatcgtggatcttgggcagcttgattacattatgctggagatcatggcaaagcgcgcgaacaagccgttacaccgctttttgggagcaaagaaggattgggcagcggcatataagggcggcggttccctgctgtcagaggatgaggatctggtagccgatatggtgcgctacgtgaacgaaggatataaaaccatcaaattcaaggtgggaagtgactggggcaagaacatggagcgggatgtcagaaggatgaggaaggtacgccaggctgtaggaccggatattgaaatcgcaattgacggaaatcaggtctggaatgtgaaggacgccttgacgtttgccggtatggttcgtccttatgagcccgcctggtatgaggagcccgtccattcccacgatatgaacgctattaaaagcctgagagaacaggtaaatatgaaaatcggatacggggaatccatgagaaattattttgcgtttgagacctatgcggaaaaaggtgtggaccacttaatgcctctagtgggaagaatgagccggatggaagaccttatgaaaatccgtgggctggcccatcaaaaaggcctgcggttctcctctggagggacggtgtgggtcaatgcggtattcggcgcgctgtacgatgaaaatgaactgctggaaaatcatgagcccatgacaagccctataggtgattgcctttctgttaaaccggaggaaaaaggagggcgtctatacctgcctgatattgagggaagccctgtcagactgaatttaaagaagctggaagaggacggtacgatcgaaagcatccgctattattatgcgtcttcctccaacacggcgtttgccgtaagagcggcctattaggcagggaggggtggaatgtccaagctggaagaaatgctgaaaaactatgagatccctaaagtgtgcagggtggagcaggagtttgaccggaccgtggttgaagatccggagcagaagctgcggatgctatgggagcaaaagcagattcttatacgccctggagaacggatcgcaataacaggaggaagccggggaattgcctgttatcagctgatcatgaagactttggtggaactggtgaagaactccggaggaatcccctttattgttccggctatgggaagccacggcggcgggactgcagaaggccagcagcggatgctggcgaatcttggaattacagaggagagtaccggcgctcccatcgtatccagtatggaggttgttgaggtggcaagaacggaattggggcttccggtgtacattgacaaaaatgcctgggaagcagacggaatcattctgctgaaccggataaaaacccatacatccattcgtgaggaatatcagagcgggctgctgaaaatgatggcgatcggcttagcaaagcataaaggagcggcaatgacccacagcctgggaactcccaacctggggcctaatatggtacgggtgggcaaggccgcgttggagcagctgaaggttaaggcaggtgtggcagtgactgaaaatggatatgagcagctggcggacatctttgtgctgcagaaagaggaaatccttaccagggaaccgcttattttaaagcaggcggtccgtatgctgcccagaatctatgtggatgatattgactgcctgattgtctgtgaacagggcaaaaatatcagcgggaccggcatggatccggcagtgattggacggccgattaaccggcgccccaatgacggtcctcatgtggagacacttggcgtgctgcggctgactcctcagtcagatggaaatgccagcggctgcggcatggcagattttatttcccaaggtctgaggagagcgatcaatgaggagtatacatgcgtcaattctctcacaggaatgcatccggagattgcagcgattccggttaccctggagacggagaaactggttttccaaggctgtatcaaagcgtctggtcagattgacggaagcaggctgaagctggccatcatccgcaataccaattccctggaggaagtatatttatccagaccggcgtttgaaagcgtaaaggagaaaggccgggtcagaaaggtgtcggattttatggatattccctttgacgatgcaggaaatctacagctgtatctgtaaccatattcagattttctgccagtattccgaagcaaggcggataaattcctttgctgcatcgcttaagtaacttccctttttatagctgacggaaatgtgccaggatggacgggaggggagatgataacaggacatgccgcggggatccagcttgtaataataatatgggataaccccgcagcaaagcttggagcggatcgtggtcacaatcgttccggtattgctggtttcaaacagtacgtgaggagtgaatccggcttcctgaaagatggagtccaccagagaacggattgtagactctttatacatcaggacaaaaggctcataccgaaagtggaaaatatccatgacggataaatcggaatcggcagagctgaccgggatggcaagctcttttaaagggtaattttccggtatggccaggatgatttcttcatcaataatatccgtgtagtggtcatttgttttgtctgaatccctcagagtcataaaaccgatgtcaagcttgccctgggagatcagcttttgctggctgtgcacgctcagctctttaggctccaggataacatcaggatatgcatggtgaaaagccggatatacgaccgaaaacatggcgacgccacgtccgggagtgaagcctacagagagaaagccttttttgttctctgcaatgtcatggatacggttataggtttcccgccgcatgcggatcatctcccgggcagtttttaagtagacttttccggcttccgttggatagcagtctgaacgggagcggaagaacagcggcgcccctaagtatttttccagctttagcagttgctggtttaaggcggactgagtgatgaaaagtttctcggcggcgcgggtaatgctgcgctcatcagcaatggttacaatgtattcgatctgtttgaggtccataagaggtactcctttctgcggaatgcaggtgaatatcgatctcttaatttatttaagagaaaaagaaaaactattaattttacatataccaccagtaggaatataatgtcaatagcaaacaggaaatagtaaagaaaaccattaaaaattcaacaaaaaaaggagaggtattaaaatgaaaaagagggttttttgtgtggtaatggcaattatgattgcgtgttccatgacagcttgcagcggcaaagaaaatggggcggggacggcagctgcaggacaggcggcaaagggggtgccgatactgtggctccccaggtgaaatggcctaagaacgtagaactgattgttccggcaagtgcgggcggagatacggattttaatgcaaggctgctggcacagaagctgacagaaaagctaccggccaactttgttgtgtcaaatgtgaacggaaacggcggggcaaccggtacgcgccaggtaaaagatggggcggccgacggaagcgcagccgtgttttatcatacagcggtgttggtaaacaaagcctgcggtgctactgattatggatttgaagcttataatttcgctgcaattgcaggacagagcgcaggaaatgttgttacggtaaatgcatctctgggtatcaaaaccctggatgagcttttggcttattccaaggaacatccaggagaattaaaaatggcagcccagaccggtgcgacttcttatgcggttgccatgcagatgaagaatgcaggctttgacatcaacatcgtagacgcagggtctgcggcagaccgtctggcggcagttctgggcggacatgtagatgtgattcttgcggcttatggttccattcgggattatgtgaaggaaggtacgctggttcccctggcaatggacggtgaggcagacctggtgatcccggaggaaaatatcgatgtaaaggccattcataatttgggatatgagaatattaagcttccgttttactattttgtggctttcccggagaaaacaagcgacgctctggtagacgaattcaacgctgcattaaaagatattattgagaatgataaggaatatcaggaaaagatttatgcgtcatattatcagaaaccggtattcctgccaagagaagaggggctcgcaaagtatgctgaagttgatgagctgctgaaaaatgttgatttctcggcaaaataaaatgttttatgttttgaggaaggagaaggtacatggagaataaaaagttgtctgagattgttgtcagcgttgttctggtgatattcggagttgttctgtggctggcttcgcaggaaatttcagtcggggcggctatggggcagggaggagattttatgcccaagctctgcaccacagtctgggtaataataagcgttatgctgcttttttccaatattaccataaagaaccaaagtaaagaaacggcatccttgaatctgaaggggtttatggcaacgtttttcctgctgtttctgtacatgctgctgttaaaaccaattggatttgtgcttacttccatggtatatatgttttttcagatgcttttgtttgtaccggcagagtacagaaccagaaaaaattacgggctttttgcaatcatatccgtgatcgtgccgattgcggtaaatgcattgtttgtaaacgtattctatttgattctgccgtcgggcatattgtagggaggaacggatatggcagttgaaggattactttcagttttgaattttggcacgtttggcgtgattctcattggcgtgattatcgggattatttttggggctatcccgggcctgacctccaccatgggagtggcgctctgcctgccgatcacgttttccatgacgccgttaaacggcatcaccatgctggtagcattgtatgtgggaggtacttccggtggtttgatttccgcgattcttttaaagattccgggaactccgtcatcagtagccacgacctttgacggagcacccatggcggaacggggagaaggcggacgggcgctgggaatcggtattttgtactcctttttggggacgattctatcaattattgcgttgatttttatcgcaccgtccctggcaaagattgcacttgagtttgggccttatgagtatttcgctatttgcctgttcgccctgactatgattggagccatggtgggtgacaacctgttaaaggggctgatgagcggaattgcaggagtcacattctcactgtttgggatcgcttccattgggggagcggagcggtttacctttggtttacaggatctggaaaacggattccagcttttgccggtcatgattggcttgtttgcagtatccgaaatcttaaacgtaggggcagaagggatttcagcagacaaatcccaagcccttaactgtaagatcaagggatttggtatcagcttaaaagagtttaaggaacagtttgttaattttatccgttctgctttgattggaataggaatcggaatccttcccggtatcggaggagcgacatccaacattgtggcgtacagtgtggcaaagcagcagagtaaatatccggagaaattcggaaccggagtgatcgacggagtgattgcaacggaaactgcaaacaatgcgtctatcggaggcgcgctgattccgctgctgacgctgggaatacccggtgatacggtaacagccatgatcctgggcgggctgacgcttcacgggattgcgccggggccgttgctgtttaaaaacagcggagtcctggtatacgggatttttgcagcatttctgattgcgacgtttgtgatgctgattgtggaatatggaggaatccgcctgtttatcaaggtgctctccgtccctaagtatatcctgcttccggtgatcctggttctttgcgtagtaggaacctatggcacgaatcacagtatgttcgatgtctggacagctttgatctttggagggatcggattttttatggaaaagcacaagttccctcaggcgcctatgattctgggattcgtgcttggtaccgttgtagaggaaaatctgattcgtggactgatgtactccaacaataatttctgggcatttttcaagtccccgattgcggccgcatttatgatattaacgttttgtatgctgatctggaccgcatataaacaggtaaagtccgtaacggcgaaaaagactgcggcagactgaggaggaaggagcatatgaagattgtatcgggcggagcggtttcggagcttttgaaaaatacaaagctgccgcggatgttccatgcaaggcagacctttccccgtctggtcatatccccggaagagatacctgctgttataaaccgggaattaggccaggaacgattttcttcattgatacggcctggcatggagatcgccgtcacagccggaagccgcgggatacggaacgtggatatcatcacaaaggccattgtggatttcgtgaaagcaaacggcgcacatccatttatcgtgcccgcaatgggaagtcatggcggcgcaacagcagaggggcagctggaggttcttgccagctacaatattacgccggaaaccatggaatgtcccataaagtcttccatggaagtggtggagctgggatattccgagttggggaagccggttgccatcgaccgaaatgcctgggaggcagacgggatcatcgtatcctgccgtttaaaacctcacaatgcttttcgcggaccctatgaaagcgggccatgtaagatgatgacggtgggattggggaagcaggcaggggcttccatcgttcatggggatgggatggatgtaatcgcccaaaatattccgaccatggcaaaagtggtcctggaaaaggcgaagatcctgtttgccattccctgtcttgaaaatgcttacgatgagacttgtaaaatcgaggccatcctggcatcggatattttaaaacgggagccggagttactgaaatttgcattttccaatatgcccaggctgattgtgggggaggctgatgtgctggtagtggatgagatcggaaaaaattacagcggtacgggggtcgatcccaatattacagggaccttctccacaccctatgcaacagggggaatcaaggtacagcgaacctgttttctgaatcttagtaaggaatcccatggaaatgccctgggctgcgggcttgcctccgccattaccagaaagatttttgacgaaatggatttagaaaagatgtatcctaattgcattaccagcacggtgttggcttctgccagaatcccctgtatcgtggcggacgacagggaggccatacagatctgcatcaagacatgcaataaaattgatcaaaagcatgtaagggtgatccgcattgcaaatagtcttcatatcgaccggatcatgctgtctgaatcctattatgaagatgtgaaaaacggacgatatccgggggtggaagcgttgggtcagccggaggaacttcagtttgacgaactgggaaatgtgataacaccgataaggtgagaaggtcagagagatgatgcgctggtgagacgaaaggaggagcagaatatgtcacggctttacgtaaaaataaaagatcaggataacgtggcgatcgcagtggaggatatcccaaaaggaacagaagtgatggaaggaattattactcgtcatgttattccccaagcccataaggttgccctctgtgacatacccaggggcggggagatcatccgatacggtgtggtcttaggatatgccattgatccgatccggaagggcgactggataaacgagcatatgctggaattgccggaactgcaggatgtggacaacatggagtttgggatcaaccttgtgacggatctgcctgatccgccggtgacccagtgggaaggatatgtcaatccccagggcgggcctgccggtactcgtaatatccttgggatcagcacgacagtccagtgtgtgacgggagtattgaatgtggcggtggagcggatgaaacgggagcttttgccaaagtatccttatgtggatgatattgttccagtcaatcatgcctatggctgcggcgtcgccatcgatgcgccggaggcaaaggtgccgatccggaccctgcgaaatctggccaggcatccgaatttcggaggacagctgatggtggtgggactgggatgcgaaaaatttacggttgacatgctttgtgacaaagaggatattacgccggaaaatgtcatcattctacaggagaaaaagggcttcgatgagatgatcagcgctttgatggagatggcggataagaagctgaaggtgttaaatgagcgcaggcgccagaccttaccgctgtcagagctgctgataggaatgcaatgcggcggcagtgatgcattttccggcgtttctgctaacccttcggccggttatgcggcggatatgctggtgaagggggcgcgacagtaatattttcagaggttaccgaggtgcgggatggtgtatatctgctggccaaccgctgtatcaacgaggaagtggggaaaaagctggcggcagaaatgaaatggtatgaccattacctggaaaatggccaggtggaccgcagtgcaaaccccacgccgggaaataaaaaaggtggtttggcgaacattgtggagaaatccatgggatctattgcaaaatccggtacatcccccatcgtggaggtgctgtctccggcggaaaggccgacgaaaaagggcctgatctatggggctacccctgccagcgatattgtctgcgggccgtgccagctggcttccgggatcggtctgcaggtgtttatgacggggaggggaactccttatggcctggcgattgcaccggtgatcaaggtttgctccagaaatgagatgaaggagatgtggtccgacttaattgatgtaaatgcagggccggtggccaccggtgacgctacgatccaggagattggaacacagttgtttcgcgagatcatcgatgtggccagcgggcggaaacagagtgcggcggagaagtataagctgcataatgatttgtgcatttttaatcctgcgccgattacatgatggaattaatgcctcctagccttataccattttatttttgctttttacctttttcttgcaaaaaaaagtctcctgtgctagtatataggcaaaatttaagcacaggggagtttgatatggatgagaattatgcagttgcgtttcagctcattatgaacgctggaaattcaaaatcgctttcaatgatggcaatggagtctgccagggaatttaactttgaggaagcggagaaatacttaaaagaggcggaagtggagatgaggtccgcccatcagtcccagatcgatttaatccagcaggaagcccagggcaaccctgttgaagtaaatattattctggtacatgcccaggaccatttaaccatggccatgatggcaaaggaccaggcagcggagattttgaacctttaccggatgatcaaggatttaaaggataagattgaaaaataaataagagcttgccgaaaacagccttcttgcacactgtcagtatttcaggagcaggaaggtttgttgcagtccagaaaaaaggaggacatgatgaaagggatcaaaatcgttaccattggcggcggctcctcttatacgccggagctggtagaaggatttatcaaacgatatgacaagctgcctgtgagggaactgtggctggtggatattgaagagggaagggaaaaactggagatcgtaggcgccctggccaaacgcatggtaaaaaaggcagggctgcccatgaaggtgatcctgtcctatgacaggcgggatgccttaagggatgcggactatgtgaccacgcagatgcgggtagggcttttggatgccaggatcaaggatgagcggatccccttaagccatggcatgatcggccaggaaaccaacggagcggcaggcatgttcaaggccttccggaccattcccgtgattttagatattgtaaaggacatggaggagctttgccccgaggcgtggatgatcaactttacaaaccctgccggaatgatcacggaggcagtgttaagatatacggattttaaaagggtgatcggactttgtaacgtgccggtgaatatggtcaatggctttgcaaggctgctaaaggtggaggcagagcgggtgaccatggagctgtccggcttgaaccaccatatttttgcaacggatgtatttgtggatgggcagtcaagactggaggagatcctggaaatctatcagcacatcagtggggaggatgccatttccatgaagaatttttccaccctgcctttttccccggaatttatccgggggcttcactgcattccctgcccttaccacaactactatttctttaccagggaacagctggaggaggaattgaaggagtatcaggaaggccgggtccggggcgaagtggtgaaaagggtggaagaggagttgtttgagctgtacaaggatgaaaatctggatatcaagccaaagcagctggagatgagaggcggggccagatacagcgatgcagcctgcaacttaatctgctccctgtataacaataccggtgatatccagtatgtggatgtccgcaacaacgggaccatcacaaaccttccggcagacagcgcggtggaagctgcctgcatcatcaccggcggagggccaaagcccattgcagtgggtgagctgaaaccccagatcaacggaaccatacagaccatcaagacctttgagcgcctggtctgcgaagcggctgtcaccggaagcagggatttagcggtgacggctctcaacatgaatcctctctgtgcaagcgatcacgatgccaatgcagtggttgaggaattgctggaagctcataaaaaatacctgccccggttctttaaaaacgaaaaataaaaataggaaaattgctgtgaaattgacggaaatagtcttttttacggcaatttttttggcattataacgggggaaatgcctgtaaataagcgaagttttcaagaaataaataaaaaatttatttttattttagaatttgcttgtgtttttgcatatgatatagtattataagggtaataagaagtggtctagaccacagaaaggggtgcgagatgtatcacattttattagtttgctctgcaggaatgtctacaagcatgcttgtaaaaaaaatgcaggatgcagcatcagaaaaaggcgtggaggccaccatttgggcggtgggagatgctgaatccgttgaagaagtgaaaaaggcagatatcattttgttaggacctcaggttcgttacctggagaaaaagatgaacgagagagtgaaaaatgagaaaccagtgcttgtcattgatatgatggcttacggcacgatgaacggtgccaaggtcctggatcaggcactggggaaattaaacgggcaggtatgaaaaagaaattcccctttacaatggttcaggggataataaaagagggagaaaagttatgggtgcatttaattcattcatggaagcaagatttatgccgatcgcagcgagaatcggctcccagaaacatttggttgccattcgtgatgcatttatcgccatcatgcccattaccatggtgggttccatcgcagttttgctcaatgtatttttaagagatcttccaaatcaggcaggaatgaccgggtttgttaaggccatgaccccgatcatcagtgttaacggtaacgtatattttggttccatcgtaatccttgccctggcatttgtctttgccctgggctacaacctttcaaaaacatatgatgtaaacgccattgcaggcggagtcatcgcatttgcaagcttagtcacctgtatgggacaaagcgcttccttcagctatgagcttccgggagttgcagcgtcggcagcggaccagttaaagggccttggccttgatgtggctgctaccgcaggaggcggtgtcacattaaacggagtcagcggctggggatacttaggttccgcatacaccggttccggcggcctttttaccgcattgattatgggctttatctgtaccatgatttacataaagctgatgcagaaaaaaatcaccattaaccttccggattctgtacctccggcagtaagcaaagcatttgcagcaattgtcccgggcgtgatcgccatttatgtggcagggatcttaacccagatctgtataacagcaacaggctccaccattaatgaaatggttcttaaatatatacagaggccgctcctcagcttatcacagggcttcttcagcgtaatcctcatggtgttcttaatccagctgttatggttcttcggattacatggacacaacgtactggctcctattatggatggaatctacttaaccgcattaaaccagaacatcgaggcatttactgccagccagagtactgccagccttccttacttatggacccgcggttcctttgacgcctactgccagatgggaggttccggaattaccttaggcctgatcattgccatcttcctgttttccaagagagaggaccagagggccattgcaaagctgtcctggccaatgggcgtattcaatatcaacgaacccatcacctttggtatgcctatcgtactgaacccggtatatttaattccgtggctgatcgttccgccggtatgcgcgaccatcgcatacggcgcaactgccatcggcttaatcccaccggtattcgtttctgtaccatgggtaatgccggcaggcatctacgcattccttgcaaccggcggaaactttatggcagcacttgtatcgctgtttaacctgtttatatcctttgccatctggacgccatttgttatgatggcaaacaaaatgaaagaagaataattgcatagaataagaaggagctgccagaccagttcgcaggggttgtcctgacagaactgatttggcggctcttccctgtagattgagaaagaaggtagggttttccatgaaaagctggactgtatttttaatcgccataggctgcctgttcattaccgtatcaccccagcttccggcctctgccatgtatatgaccgttggtctggtatttatactgctgggtgcagttatgctgataaagaaaaggaaggaatgagggggtatggtatgagacttaagtttccggaaggattttactttggcagcgccaccagcgctgtccagtgtgagggaagcacagaaaatgacggaagaggaaaaaatatctgggatctctggtatgaggaggagagctttaaattccatggaggcatcggcccaggcaccacttcttccttttaccggaactataaggaagacatccggctgatgaaacagacaggccataactctttccggacatccatcagctggtcccgcctgtttccccaggggtttggggaagtaaacgaaaaagccgccgaattttaccgcagcctgtttctggaattaaaggaacaggggatcgagccctttgtgaatctgtaccattttgatatgccggtaaagcttcaggagctgggggatgggaaaacagaaaggtggtggattattataaagaatacgcctggacctgctttaacctgtttggagatctggtcaagcgctggtttacctttaatgaacccattgttcatgtggagtgcggatacctccagtgctaccactatccctgcaaggtggatcctaaggcagcggcagccgtggcctatcatacggcccttgccagtgccatggcggtgcgggaataccactccatgaagcagggaggaaagatcggaatcatcctgaatctgactccggcttatcccagaagctcccatccggaggatgagaaggcggcaaagattgcagagctgttccagaataagagctttctggatccttcagtaaaaggaatttatgatccggagctggtggatcttctggaaaagcacgggttgctgccggaagctgcctcagaggatttagaggttatccgtctaaatacggtggatttcctgggagtgaactattaccatccgttccgggtctgcgcaaaggccggccttcccaatccggctgccccatttaccccggaatactattttgatatctatgacatgcccggcaaacggatgaatccctaccggggctgggaaatctatcccagaggcttatatgacattgcccttaacatccgtgacaattatggaaatattgaatggatggtcacggaaaatggcatgggtgtggaacatgaggaacgtttcagaaaagacggcatgatacaggatgactaccgcattgaattctataaggagcatttaacctggcttcataagggaatggaagaaggaagcaactgcatcggttatcatgtatggacctttgtggactgctggtcatggctcaatgcctacaagaaccgttacgggcttgtggagctggatttggagactcagaagaggaccataaaaaaatcaggctgctggtatcaggagctgcttaaaaacaacggctttgaataggggaaaataggagagaaatatggaagtaagtcggaaactgaatgtagaggcaacggaattttttaatgctctggcgtcttcggtagcctatgatatcacccaggccacagggaagaaggtaagtccggaccagatttattccggcttccgctataaaaagaagatgaagaataaaatggggcaggaaagccatgtggatgtggtgatcaggcaatttgtctctcccagctgctatgaggcagatttccgttcctcccagggcacaaatgttattttttacgagatcgaagatagcaaagacggaaacattgtggtacactacagggagagattcgagggagacagtacttccggttccttaaattataagattgtttcctggctttatcaaagaagttcaaaaaagaggatttccaggatgctttcgtccatggagagctttattcatgggaagaaaacgagctgaggcgatatgcccgcctgtccatttggcggctgcctttggaaggcaaaagagaatgaatggggataagaggtgatacaatggggctccgaaatatcagaaaataaaacaggaccttatggaagaaattaaggatgcgtctgtcaatacccctattgcctctgaacgggaactggctggccggtataaggccagccgcatgactgtgcgtaatgctttaaatgaactggtggaagagggagtattatacagagataaaaataaagggacgtttgttgcagatcaaaggctgatgaagaaaaacacatcggcggaaactctgaataagcccatagatgatacctacgattacaatgtgatctatttcagttcctgcttttccgatgaaacgatggcttcttatctggaaatcgggcctgaggaccggatgatccggatcgtccgcttaaaccggaagaacggaaagcccttaagcgttgaggaaatctatttgattcaaagtctgatcaatgacagcgattataataacttaaataagcttttggatttaaaaggatacattgacgaaggctcggtcacacaaaagtttctgccaattacggtgcctgtaaaatatattaatctgcttcatgttaagctgaatacccccatcatcatggttgaaagcatcattgtaagcaaaagcggaactccggtcgtgtatatcagggagtttaacaacccctttgaaaagattattgagataactacttaatgtaaatttaaaaggaaaggaaagtatggttatctgtttcaagatatatcatacaagacagctatggttcagaagaatacggaattacccagggtatttgacagtttcgcagaagcaagaaaaaacgggtttctcgccatgaagaaacttaaatgttcaggcaagggggtggtgggccagttctgtacttatactcctctggagatttttatggccgcggatttagtgagcgtaagcctttgctccaccagtgacgagaccataccggaggcggaaaaggtgctgcctgccaacttatgtcccctcatcaaatccagttatggctttgcgattacggacaaatgcccctatatgtatttttccgatctggtagtgggcgagacgacttgtgacggcaaggtgaagatgtatgagctccttggacagaccaagaatgttcacgtcctggaacttccacaccgtcagaacacccccgaagccaaggctctttggcgggcagaaatggtaaggctcgttgagcgtgtggaaaaggatttcggtgttgcaattacggatgaaatgcttaaagaagccatacgcaagcgtaatgtggagcgcaggcttttaaaagaagtgtatgagctcagtaccatgtgcccgcctcctatcagcggtctgcggcagctgcagattctctttggtgcccagtttaagtttgactggcaggaaaaagtggatgagatacagaatgccattgacagcataaaggaggcctattgcaatggagaacggcccattccggaacaggcgccccggattctgatcaccggctgtcccatgggcggggtgacggaaaaggtggtaaaggtgattgaggatgcaggtgccgttgtggttgcctttgaaaactgcaccggcgccaagcagatggaccgccagtgccgggaggagggagatcccatcaccaacatagctgaccattatttgaacataggctgttccgtcatgactcccaaccctaaccggttcgagcttcttggccgtctgtgtgaccaatttcaagtagacggtgtggtggagatgaccttgcaggcctgtcatacctatgcggtggaatcttatacggtgaaaacatttttaaaggaaaggaatattccttaccttcatctggaaacggattatggaacctctgacatcggccagctttccacccgcgccggcgcatttgtggagatgctgtagcaatgggggcataacagcaggaattgattgcggctcagccacctgtaagggagttctgatgaaggataaaaccattgcggctatgtgcgtgaagcctacgggctggagcccaaaagagacggcaagggcggtccttgcggaactgatggaggaagcggggacagtccgtcaggagatgcaggtcattgccaccgggtacggcagggtgggaatcgattttgcagacaaagcggtgacggaaatcacctgccatgccctgggggctgagtaccttatgccaggggtacggacggtcattgacatcggaggtcaggattccaaggtcatatcggtggaacagggaaaggtggtctcctttcagatgaatgataaatgcgccgccggtacgggccgttttctggagatgtcctcccaccgcatgggtattgatttatcggatttatcagagctattgaaagctggtaaatgctgttcgctcagcagcatgtgtgccgtgtttgccgattcagaaatcgtttcccttctggcatcgggaaaaagccgggaggaaattgccggggggatccttcaatccgtggccacccgcgtcatgacattggcgggccgcatggatcttgcatctccggtgcttttaaccggcgggctgtcagcgctttacgggcttccggcagctttggagaggcaggtgggttatccggttgagacgtcctctctgtcccgttatgcaggggctataggagcagccttaaggggatgaggacagccatatcgtatgtaatatataaatgaatttacgaaagtgctgggaaacggaagatgtatgcctgatgaccggcactttttagtataccgataaacatggagattggaagtgatgcagatttaagaccttaatacagtctgttgagatatatagaaaaatcaaatatctatatgctttttttctattagtccctgcctgagaagaatggtacaatgaaaaatggtctttcaatacatatgaaaggagaatacagagttgtttgatttctcttattttcttgaagtatttcctaaaattgcgtcaaagctgcaggtgactctcagcctgacttttacggcggctgttttttctctggttatcggaattgtcattgctgtcatcggttattacagaattaaggttttatatccattgacccgtttctacttatccgtgctgcggggaacgcccctggtggcccagctgtatttcttttactatggtctggcccgcctcagcgagatcgtgctgaatatggagccgatgacagctgttgccctggttttgagcctgaacacgggggcctttatgtccgagagcatccgcggggctttgttttctgttgaaccgggacaaaaagaagcggcggccatgctgggcatgacggagcttcagacaatcctgcggattgttctgccccaggcttttcgtgtggccctgccgtccctgtttaatgacttgatcaacctgctgaaggcaacatctctggcgttcatgctgggtatacgggatgtcatgggacaggcaaagagcgaaggcgcccagtctttccgttattttgagatttatctggccgttatgctgatttactggctgctggttctggttcttaccaggatccacaaggtccttgactggaaatgcacacagatgtattaatcttttaccataaagggaggaaattcaaatgaaaaaaatgttaccttttttactgacaatgactgctgttcttctggcaggctgcagcagcagtccggcaccggccaatccaccatcttcggcggaatccacaaaagcagcagcggatactacgggcgctgcagatagcgcaagtactgcaggcgagacgaaccagacccgtaaggtcatcgttgccaccggtggttccggggagccctacagtcttcttggcgatgacggcaagacgtggacaggcattgatgcggagatgtggagcgagattgccaggcgtacaggctgggaggtagaaccaaagcaggtggagttttccgccctcttcggtgaactggatacggggcgtgtgaacgcagcggcaaattgctttgcaacaacgccggcccgtatggagaaatacatcacatcccacccctactatggagatgcccagtgcatcattgtcaatgaggataaggccgatgtaaattcctttgatcagctaaaggggctgaccatcggcgtggctcagggccaggcctcccaggtgtctgtggaagccatggcggaaacctacgattggaaggttacagtttatgagacaagtgataccggataccaggacctatatttaaagagaatcgatgccatggcaaccacagacagccttgtttataagtatgaaaaccttcagaatatgaaatttcacattttggatgagcgccttatgtccaataacgttgcctactttttccaaaagaacgacgagggacaggctctctgcgatgaagtcaacaaggtactggaccagatgatggaggatggaaccacttctaaaatcattaccaaatggatgtattccgacatgacgaagctgattcaggaataaccggccaaaggaggggctttccgtgattgaaattaaccatttaaccaagtcctttgacggaaagaccgccatattaaaggacattcatttaaccattggaaagggagaagtggtggcggtcctgggtccttctggaaccgggaaatccaccctgttaaggtgcataaattatttgacagagcctaccgaaggaatcataagaatcggctctgccaaggtagatgccagacggcatacgaaaaaggagatagcagagcttcgaagccactcctccatggtattccagaattataacctgtttagaaataagactgcaaagcaaaatatcatggaagccctgatcacggtggctaagatggataaagctaaggcccaggagatcgctttgaatcttctggaaaaggtgggtatggctgatcggggagattattttccgtcaaagctttccggagggcagcagcaaagagtaggcattgccagggctttggcggtgaaccccgacgtgctcttatttgacgaacccacttctgctctggacccggaactggtgggagaggttttgaacaccatacgggcagttgcggaagaaggagccaccatgcttcttgttactcatgaggtacggtttgcccgccaggtggctaccagaattttatttatggacgagggtaccatcattgcggacggaacaccggaggagatactggactttccccgggatgccaggcttcagcgtttcttaagccattgcctgaaatagggaaatacgcagcatttaaccgaatcagattgcgaatatccgcttgacataaatgatagtcaaaaatataaaagaaaggaaagtatgatgatatgcttcaagatatgatcatacaggattcatgatgggaagacttgggatttccctgtatccggagcattccactccggaacgggataaggaatatatcaggctggcaggccaatatgggtttcagcggattttcacctgcctgctgagcgtgggaaataaggacaaagatgaaatcatcaatgagtttcgggatatgatcgatacggctcatgagtccgggatggaagtgatcctggatgtggcacctcccgtctttgatgcgctgggggcttcctatgataatctggctccctttaaggaaatgcatgccgatgggatccggctggatgtgggttttgacggcatgaaggaagctgccatgagctacaaccaggaagggatgaagatcgaactgaatgccagcaccgatccaagctatgtggccaacatcatgaaccaccatcccgtgccggaacggatcattacctgccacaacttttatccccagaaatatacgggggtcagcctggagcattttgatttctgcaacagggaaatgaagaaacacggccttaaggtggcggcctttgtatccagcaacaatgagggcacctttggcccatggcctgtgaatgaggggctttgcaccctggagatgcacagaggcctgcctattgatgcccaggtgcgtcatttgctggcgacccgtttggtggatgatgtgatcattgccaatgcctatgcatctgaggaggaattaaaagcctgctcctcagtgacgcccggaaagctgatgtttggcctttgcctggaaaaggagctgacggaaacagagcgggagatcctctactttgaccagcagcacgtgatcaggggtgatatcagtgaatatatgatacggtccacatggccgagagtatcatttgcggataaatccgttcctccggccaatacccgggatttaaagcgtggggatgttgtgattttaaacgacggctattcccgctacaaaggggaactgcacgttgttttaaaagatatgccaaatgacgggcgaaagaatgtaatcggccatataccggattatgaactggttctgcttaattatatcggaccatggaaaatatttggctttacagaagtgtgatttgtttttaagagcaggaagagacagcacggcggtgagattcctgttaacagattccatgtattttgctctttaaattgagcaggagttatatagtgaggaacagaagaaatgtgccttgtaatataatttaatgtatttaaaaatatcatcttgagcttgttcaggagtctcataacagacaccttgaataagctctttttttggcccaataaaacgattctataagcccttcttctttttgatttcctcttaaataaggttacagacagattccggccataccaaatctgtctgtttatcagccatgtattaatctgttctaaatagaatatctgattacttccaaaaataattacagcttttatcctggattttcgttaataattacagcagaaatcagcccgtccgattcatgggttttcctgtatggcttttaacctttcatttcattccagagctgcaatcacaccatgaaccaatgcctccatatcaaattagccagtcatggcgcagaatggagctgtcaaggcttttcctctctgaagtaactcacttatgataactgatatttatagctcaccggtctgttcaaagctgcttaatatattttccatacttctggtaatgtgttgttccatgactgcccgcgctttttctgcattttttttctgtacaaactgcagcatttctatatgttcctttgttgatttgatatgatgatccgcttcagaattggcttttcccgtacttggtccattccacagtcccagtagaaaatcatatagcttctggttatcagccgctttccaaatcgccatatgaagttcttgattaatattaatatagtcctggtaagacgtagcttctgcattatctgatatatggtaaagcttggccaatagatcagaaacctccatatttctctttgcggctctgtaaatagcttcgccctccagcaacgttctcatctcataatgatttgtaataaatttcttatctattggctttacaatagcacccttgttcattctcaattcaattaagccctcggcagcaagagattgaaatgcttctcgcacgggggttctgctaactcctaattcagatgcaattcctgtcaggctcagctcctggccgctcttatattctccggaaagcaacgcttttttcaggattgatgttatgcgtgcccgggtaggcatcatttctaatggttccatgttctcacctctatataaacagtctgttttttcatatatcataatagcataagctatttttgggtgtcaaactcgaaattatttgatcagtcttaaatcaatgattcctgtagaagtttttcgtcaaatataataagtcccaacaaagaatattgttaaaaagtaataaaattaaagagagaataaaaactatagttgcacaaactgtatcaacatgctatagtttacacatcgaaatcgtatatcgtatacgatatacgaaatacgatatacaataaatgaggaggagaatcatgcatgcaattgaaaaaattcttgcaaaaaacagcggatgttctgcagtaaaagcgggagaaattgtgacagcaaagatagattttgctgaaatcaatgatttgtatctacagacagtgtattccttctacgaaatgggtggaaagaaagtatgggataataccagggcagcgtttgtctttgatcactatgcaccggcaccggatattaaaagtgcggcaaatcatggggaaatgagaaaatttgcaaaagacaatgaccttaaattccactttgataccaactgtggggtttgtcatcaggtcatgccggaggcaggggttatctatccgggtatgattgttgttgcaacggacagccatactacaacacacggtgcgtttggagcgatgggaacaggctgtggagcaacagatatggcaaccattctgatgaccggggaattatggttccgcgttccggaaataatcgaagtacgcctggaaggagaggccccaaaaggtgtgtacccaaaagatgtaatcctcagtgtattgggaaagctgaaagcagatggcgcggtatacaaagcaattgattttaccggaagttatgtggaatccttaaatgttgccggcagaatggtgatatgcaacatggccgtagaaatcggtgcaaagactgcttatatgcagcccaatgaaaatgttctggagtatgtatccagccgtgcggtccgtccatatgaagttcagtacacagatcctgactttgagtatgaagaaagctatgtattcgatgtatcggccttagagccattgttagcatgtccccacagcgtagataacgtggatactcttaacaatgttatttccggcagacctgttgaattgaaccagggttacataggaagctgcactggcggccgtgaagaggatattgcaattgcggcagaaattttacgcggaaaggaaattccaaagtataccagattggtaattgttccggcatcaaatgaggtgatgcagatctgcatggaaaaaggatatatacaggatttaatgaaggcaggtgcaacggtgacaactcctggctgtggggcttgcctgggtgcacatgaaggtatcatagccccgggtgaagtgtgcatcagcagtaccaaccgaaacttcccgggacgaatgggttcaactcaggctgaaatttatctggcgagccctgcaactgtggcagcaagtattctgaatgggaaaattactgacccaagagattatttataggagggagtacttatgaaaacacagatatcaggaaaagttacagttgttggcagcaatattgatacggatcaaatatacccggggcgttttctggctatcacagatggaaaagaaatcggcagccattgccttgccggcgttgatgagtcaatagctgaaaatttcccggagggcggaattgttgtagccggaaccaactttggctgcggttcaagccgggaacatgcgccgatcgcattgcttaatatgggggcttcggcagtagttgcagaatcctttgcaagaatttttttccgtaattctataaatctgggacttcccctgattatatgtaagggaatcagcaaaaaagttaaagatggtcagacgataatggtggatatccggaaaggtacggttaccatcgaggaaacgtatgaagaactcatttgcgacagactgggcgatcaggcaatgaaaatattagaagccggaggaatcaagccaatgatgcgtgccagattcggtggaaaagagtgaaaaataaagggggtagttggttatgccaatggaattagtttttttaattggaatcgcagttttgctgattttatgtattaaggttaaggcaaatgcatttgttgccttattagtgacaggtttaattatcggcgttctatctgggatgtccggttctgacacagtggaagccttaaccaccggattttccggaactgtaaaaagcattggtatcattattatatttggaattatgcttggcaactacttagatgccgctaagggtaccaaccgcatggcattggatgcgattcgtctggtggggcaaaagcgtgccggattagcaatggcaattaccggctatatcgtatcaataccggtattttccgatgctgcatttgtgattttaacaccactggtaaaagcaatcaataaaaagaccagaattcctctggccattctggcagtaagtttatcctcaggtcttttagctactcacgtgtatgtgccgccgacacccggccccctggcagcagcaggccttttaggtattgacattggtgaggcgattttgtatggagcttttgccgctgtatttatgacggcatttggctggatctttgcagaattatattttaaaaagaaaccggacagtttttatacattccgtgaaggagaagtgccggaagcggttggagacgacgcggacgatacctctggtcttccaggaaccctggccagcttacttcccctggttgttccgattttactgattatctctaaaacaacatgtgacatgttatttccggcagactctttggtggtaacggtcacctcttttgttggtgattccaatatagcactggcattgggagcagtgctggcgatcattacgttaggaaggagaatgggcggtaaaaaaattattaaggtaatggatgacacattaaaagatgcaggccctatcgtatttatcacggcagccggcggcgcgttaggacaggtgttaaaggtttcaggtgcaggagacagtcttgcaactatggtaattaatacaggactgccatttatcctgattcctttcgtgatttccggattgttaaaagtagtacagggttccggtacagttgcagtgacgaccgcagcaacactttgtgcaccaattgccgccagccttggtttgaatccgatcctgatttttcttgcgtccggtgcaggggcacgtgtttgctgccatgtaaacgacagcttcttctgggtgtatacgaattgtatgggatatgatatgaaaacagggttaaagacattatcgatttctaatatatttatgtccataggtggtttggtcgcaacatttatctgcagtttatggttatagtttttttcaatgatttaatcagtacttagagaataaatccaatttatgccaaaatgccatagaaagaataggaaagatattctttctatggcattaaattgatttaagaaaagtaaagaaactcttcctgttttttcattggattttatatatcttcctgaaatacaagcctgcgtatggcccaggccaccccgtcttccctattggatttcgtatggtattttgcagcctcacggatgcaggacatggcgttttccatggcaacggtccagccgaattccggtgtgaacatggacaagtcattgtcgctgtctccaaggaccattacatcctcaagagaaattcccttgctctctgcataggcttttagggcaggccctttctgggctgcctggttggtcagctcaatgttgttggggaaggaagatgccgcagccagatccggataacctgcgaaaatttcctttaatgcggccaccttctggacggaaagcccgttgctgcatattttaaataccgtaatatcctcagaaagatccttaagcgaagaaataaatgttgtggattccatccgcttttgtacggcgtcctcaagctctctggaaatggaagcaggggatccgatcctgccgcttaaaaaggagtacaattcctccagtctccggtcttccgggcagtggtataccgtccatgggaggtcaggatatccatatccacctcctgctctgtaaggattcgttcaatatcgaccagattctgatgggtgagaggaatctcatttaaaatttcgccatcctgactgtatacggcagctccgcttaaacagatgtagccgcatgtgatgtcacaggactccatcgcggatctggcgtcttcataatcccgtccgctgcagattaaaaattctatgcccgcgctttcaagcctgcggatcgcatctgcattggctttggaaatattggtctgagggtctaaaagggtgccatccatatcggaggcgatcagtcggatgctcatggcaggtaatctccttatctgtgaatgtattcgtattcttatacttagcttatcttaaatcaaccggttcgtcaatgcagaggggccggagagtcctattttcatcagatttcatatccttgcaatgcattttcccgttcttttttacaatctccacatatcacttttaaatcaggcatggcttacattgtcttaatttttataatagtttgcacaattatttaatgagaaatgtttccatatatctaaatagtatctattaaaaataaaaaaacttgtctttttttatatactttgcacttaaaaaaacgaattttgaaagaaaacctattgacaacttggcagccaagtgatattctaatgccaacaacttggcagccaagttaaaagtgatgaaaaacagcaaaaggaggagaatatggaaaaattgaagatgatgcatattggaatctccaaaggcgatgtagggcggtatgtatttttgccgggaagtccggagagggcggaaaagatcgcctcttattttgataacccaagggaaattgcatataatcgggaattcaggacctttgcaggtgagctggacggaactagggtggcagtaaccagcacaggtattggagggccttccgcagccattgccatggaggagctttaccaatgcggtgcagataccatgcttcgcatcggctccggtgcttccacttcaaaaaaggtaaagacaggtgacattgtgattccaaatggagcagtaaggatggaaggcgtgggcaatcattacctgcctgtggaatttcctgcagttccggatttttccatgatcaaagaactggaggcagcctccaaaaggctggacatgccctgtaatgtgggggtcacgatcacaaaagcctccttttacagccagacccagccggagaaaaagccggtaaaggatgagatccttcataagtggagctcatatgaggcaggcggagccacctccaccagcatggaatgttccaccctgtttctggttgcggccagtctggggatccgggcggcctccgtattagtgagcgcaactgattataaaagtacttcggcagaggaccgggtacctcttacagagctggaaaaccgggtgatcctggttgggattgaggcgatgagagccataataaaaaatgatttggtggggtgaatggtatgatggactacaataaactgccgcttttgggagaagacatttcagaaagcctggtgatacctaattacgtaaaaatttatgatattatttttaatctgatcgtagaaggcgtgatcaaggcaggggatgttgttccaagtgaaaataaactggctgattactggaaggtcagccgcggcacagtcagaatggctatgagaaagctggaagaggatggatacataaataagacccagggaaagcaggcggtggttgcaacccatgcgctgcaatataaggatggcttccagtggctgtttaacccgtgtattgagaactgtgtggataccattgatgaaatcaggatttccgcccagtaccagccttgcggcgtttacgttgcccatgagctgggacataaaaagcccggtgatttaatggttcttaacaacaccaattatttttccaatggacggcagatggcaaacacggtcaccatctttgatgcggaatacattgagaaataccagcttgatataaatgatacggaaaagatcagggaattcagcgtttatgggctgtaccggctggcaaagcgggccaaaaccgtattcaatgtattgaacgcggatgcagattcctatattgagggcatcaacaaaaatgaacctgtcatcattgtggaagagatcctggtggatgaaggggacaggccccttagctatgtcaagcaccagcttctgggaagcaaataccgtttttccatggagcgtaagtctcacttgtaattgaaaaggggcataccggccaacgggttacaggcaggagggagagctcttttcaaatatgctgcaaaacaaacagatatgattcagcaacagagaggagaaagggaatgaaaaaaacgttaagtctgattatggcaggagttcttacctgcaccatgctcaccgcatgcggcaaaacaaataacggcgcacagagtaccggcggagcacaggagcaaacaaaggagacagatggggcaaaggaggagaaggcatcggaaaagccattgaaagctgtgtacctggtaaacggaaatttgggagataaaggcttttatgattcagcagccagcggcctttaccgcatgagagatgagcttggggcagatatcaaggtggttgaaatgggccgtgatgaaaccagctatgaaggccattttacagatgtatccgagcaggattgggatgtcatcatcgcgggtacctggtcggtaaaagaggtggcgcagaatacggcagcccagtatcctgacaaaaagtatattttctttgacagcgatgtggaccgggacgtggtgacagaaggaaatatgatgggaattacatacaattccaatcagggctccttcctggcaggcgttctggcagcccagatgcttgattccggagatgcaaagatcgatgcctccaagagaaccttgggctttatcggttccatggacgtggcaaatatcaatgacttcctggtaggatatttagaaggtgtgaaatatgtagatccaagcatcaaggtgatcccttcctatgtgggttcctttgaggatgttcccaaatgtcttgaaatgaccactcagttatataaccagggcgcgcagatcgtatatgcaccggcttcccagagtattcttggtgcggcaacagcggccagcaacgttgataaatacttaatcgcctgtgaccaggatttatatacccagttaaaggaaaccaatcctgacatcgcaaagaacatcctcacatcgaccttaaagaatgtgggcgattccctggtgacagcggcaaaaggtctcatagacggttccatgacctgtgacgagacctatgccctgggccttgacagcggtgcagttggtctggctcagaatgataattttaactccatcgttacggaggatatcaagaagaatcttgaagcagtgagggacaagatcatcaagggtgaaatcacagtaggaagcgccatgaagatgacgacggaagaagtctccgcattgcgtgacagcatgaaataagcctgttattgaaaccatagggcagcagcaaaataaaggcgtccgtatattttgctgctgccctttccagaaggatttttaaggagtaataggatggaagagagaaaagaagtattgcgggtggaaaatattgttaaagtatactccaacggcgtaatggcgaataaggggatcaacttctccgttcatgccggagagatccatgccctgtccggagaaaacggggcgggaaaatccactttaatgaaaatcatttttggcgaagaacagccgacctcaggagatatctacgtcaatggtgtgaaaaccatcattacttctccccaattagccatcagcctggggatcggaatggtacaccagcatttcatgctggttccctcgctaacggttgcggagaatgtcatcctggggttgaacctacaaagggtctgctgatcaacagaaagaatgctcacaagcaggtggaagagatggcggataagtttaacatgcaggtgagtcccagggcaaggattgaggagctgacagtgggtcagaagcaaaaggtggagatattaaaggcattgtttcgcggggcgaaaatactcattctggatgagcctactgcagtactcactccacaggaaaccacggaattatttgaggagctgaaaaggcttaaaaacagcggctataccataattttcatttcccataagctgaacgaagtaaaagagctgtgcgacaggatctccatcatccgccagggaaggtccatgggcctgtatgatatgaaagatgtgacggaacaggacatctccaacctcatggtgggaagagacgtaattttaaacatagagaaaaacccgccaaagatcggcaaacccaccattaaggtaaagaatttatccattgccggtgagaatgggaaaacttatgtaaacaatttatcctttcttttaagagaaggggagatccttgggatcgcaggcgtggagggcaacggccagtcagaactggcggaggctctgacagggcttcgtaaatataattccggttccattaaactgtgcggcaaggagatttccggatgcagcatccgggatatacgggccctttctgtttcccacattccggaagaccgcatgacaacaggcgtggcttcagctctttccattacggaaaatactctttcagataaaatttcctctaagcagttttcaaagcgcgggatcattgataaacgcagagtaaagcaatacggccaggatatggtaagagattatcaggtgctgtgcaagaatcccgatgtgaggatcgacagcctttcaggcggaaatatccaaaaggcagtgctggcgagagaattgtccagcgatcccaaggtcatcattgccaaccagcctaccaggggcgtggatgtgggcgccaccgaattcatccggagaaggctgattaaaatgagagacagcaagaaatccgtattgctcatcagctcggacctaaatgaggtgctggggttatccgacagcatcattgtcatgcatgaaggccagatcgtggcgtattttcctgatgcagggaagatcagtgagctggaactgggaaaatatatgcttggaattgaaaagcagtctgatgcagagataaaggaggtatgtcatggacagtaacaaacgaattcacttaatcgtggatctaacaaagctgctgatcacaattttggtatcctgcggtctggtcactgcgattgtattaggaaccagttctgagccaatgaacgcttttttcagcttttttgtcggtcccttcacttccttccgccgtatcggaaacattgtggaggcagcctctccgttaatgtttacggccctggccgttatattgatcttcggagccggacagttctccatgatcgcagagggcgcttttttcatcgggactcttggtgcaatgatgattgccacctccgtgccgctgcctgcgggaatccattcggcggttgcactgctggcggcggcggccatgggtgctgccgtggccctgatcccagctctgctaaaaatgaaatggcaggtttcagaagtggtgacctcgttgatgctcaattatatcgtccagttttttgcaatctacatggtgagctattatttccgtgagatcagcagttcaagcctggcctccattgcatttctggacacctccctgcttccggtgatcataggcggcaccaggattcacgtcggaatcgtccttgcggtcgttctttgcctgtccacttatttcctgctttttcgcactacctttggaatgaagctgagaattgtaggaaacaaccccaagtttgcaaattactcgggaataaaggtcaccggcgttatggtggcctcccaggtaattgccggagcccttgcaggagtgggaggcggcgcggagcttttgggcatgtacacccgttttaaatggaccgcaagccccggatatggctggaccggaattgccgtggccctgcttgcaagaaacaatccccttctggtgcctctggcagcccttttcatgggatatctcaatgttggggcaaacattatggcaagaaacagcgatgtcagcagcgaagtggtaaagatcatccagggagtcatgatactgatgattgcagccgaggctctgcttaagaagtggaagcagaaaatgatcgtagaggctgcaaaggcagaaacaggaatgaaacaccctgcgggtataccactatgtccaaaaagcgtggagggtaataatgaaaggagaaatagtaaatgattgattattcatttatcgtggatttcctttttatgtggatccgtgtggcaactcctattttactcactgccctgggtgcggtgatctgcgaaagaacgggagtggtcaatcttggattggacggaatcatgcttatttcggccctgttcggggttttaggaagcgcctggggaggtaatctgttttgggggatcgttgcaggcgttggtgctgccctggttgtaagcggggtttttgcatactttcatctgatgttaaaggctaacgccgttttgtgcggcacggcaatcaacaccattgcaggcgggctcacggtctttgtgctccagctggcaacaggagaaaaagggtccagttcatccttaaaaagctatagttttccggcagtccgcattcctgttataaaggatattcccgtgctgggagatattttatccggccacaatgtggttacatactttgcctttctcatggtgatcgtgatttcggtatttttataccgtactccaatgggacttcggatgagggccgtaggggaaaatcccagcgcagcttccagcgttgggcagaatgtggttaagatccggtttttggccattttattatgcggtgtaatggcaggaatgggaggaatgtatttatccatgggctacttatccatgtttaccagggacatggtggcaggccggggttttatcgcacttgccgcctgcgccatgggacaggcaagccctgtgggagccttgatctcctccatggtgttttccttctttgacggcctttccaatatcctgcagcttttacagatcccgtcggaatttgtacagatgctgccttatggggccaccattttaggcctgaccatttactcgatccaaaaacagagacagaaaaataagagaaatagggagatgcagcaaaatgtcattaaataaagatgaaaaaaccattggaaaaagacagtaccacattcatttaagtcccggagatatcggtgaatatgttttgcttccaggcgatccggcccgttctgaccgggtggcaaagcacctggaaaatgctgaactgattgccaataaccgggagcaccgaacctttacaggttattataaaggggtaaagatttccgtcacctctacgggaatgggctgcccttcggcagccattgcagcagaagaactgatcaatatcggcgcaaaatgcctcatcaggatcggaagcagcgcggccttgcaggaaggaataaaaataggcgacttaatgatctccaccgcatccatgaaaaacgaaggcacctccagattttacgtgccggactgtttcccggctgtaccggattttgacttgacaagagtgctgatcgatacggcaaaggatctaaaggaggagatttccggcagcatctattacggcatcaatgccagtgatgacgcgttctatggagaaacagaggaatggattgaaaaactgtcaaagcttggctgcttaaatgttgagatggaaagctctgccctttatacagtctgccatcgcaggaaggtaagaggagccatgatcagtgccgtctccggcaacattgtcacaggtgaagtgatctatgaaacggagaatacagggctggcatccggctgggatgatgagatccgtgtggtgctggaggcaatttaccgtttccataaggaaaaccggcaggatattccattataataggaagatactcggtgtggttttcctgaagctcaaagaatataaacgggaaatagaaaataccctggggtatcccttcatgcccggaaagcatgggcagataataggaaaagtcaggagaagacaggatatgcaggaaaagaagatgatgcatttaagcgttaccaaagatcagatagggcaatatgtatttttgccgggaagtgtggaacgggcagccaaaatagcagcttattttgataatccggtgaaaatagcccatcacagggagtatctcacttacacaggaaccctggcaggagtccaggtctctgtaaccagcaccgggataggcggaccttctgcggccatcgctgtggaggagctgtatgaatgcggcgctcacaccatgatgaggatcggttcctgtgcttccacctctcccaaggttaaggtgggagatgtgatcattcccaacggagcggtgagaatggagggaacagggcttcactatctgcctgaggagttcccggctgtgccggattatgagatggtaaaggagctggaggctgccgcgaagaaactgaatattccttataatatcggagtgacgatttcaaaggattctttttatacagaggtttcccctgagacaaaaccggtgtattatgagctgaaaagcaagtgggaggcttacgaaaagggcggagccaccaattccagcatggagtgtgccaccttgttcctggcagcggcctccctggacatcagaatgtcttccgtcatgatcagcgcgacaaattacaggagctacagcaatgacgataaggactacccaagagaatgggaggacagggcgattcaggttgggattgaagcgatgacacagattataaaaaaggatatggcagtctgctgattgggaatatccgattgactaagccgtgggaaaggaaacagaatcgatgaaacatattatagtggattgcgatacgggcattgatgattcaatcgccatactatatgctttaaaaagcaaaaagcttcatatagagggctttaccaccgtatatggcaatacctcgtccatgcaggcggcggaaaatacacttcgtctgatcaagctggctaaatgcggttatgacatacctgtcattgtgggcgccaatgagagcctgaccggagaggtggagccttaccctgtccatatccatggagaaaacgggatcggcaatgtggaattgccggtatcagaacaaatgcctttgaatgaggaggcagcggactttatcataagaaaggcagaggagcttgggggagatttgaccattgttaccctgggacggctgaccaatattgcggcagctttagaaaaggatcccaggcttccctataaaataaagcacatggcagtcatgggagggaacttccacaagcccggtaatatcaatgtctatgcggaagcgaatatctacggagatgcaaaagcctctgatattgtgttccgggcgggctttcccatgacagtggtaggtcttgacgttaccatggagacctttctgtctgcccgggatatttccctccttggaaagtactgcagggaggaaaaccgggagatcgtggagtatatgcagtctgtcctggaatattacttcaagttcagctatgagtccatgggcagtctggactgctccgtggtccatgatcctttggcaatgttgattgccgaggatccctccattggagaataccggatggcaagggctgcggtggagtatgaaaatgaggaattccgcggcatgatcaaactggatgaaggctttattccggtctatgatcatgaagagatccattactgcgtccgggtggattctggtctggcagtcaggaggctgctgtcagttttttagagtcatagaagaaggaatccgttcctttcactgtcaatgtgaggacggattcctttttttattctgcaaagatttcaggctgacagcccggaaggtaaattcttccagaaggaaaaaaagctactgcttgcacgatttaagaataagtggtaacattatccaatagggcggctggaagtttgcccataaatgaagaagctgctgtacatgtgggaggaaattatgagtgaaaaccaacgatatgagctgtactgtgagttgatccgggatttggatacggggtgcggactcattatggaatatgattcgctgttacatgattataagggaaccactctttatcaggcggaggcccagatcttaaagatggtgggtcagcagcccggcatctccgccgccgagtgtgcccggaccttaaataagactttaagcgcctgctctcagctcatcaaaaagctgcgggccaaggaatggattttacagaagagaaacgaaagcaataaccgggtctataacctctaccttaccgaatccgggagggagctgtttttaaagcaccaggaatttgaaagctgctgttatgaacgaacctaccacttactggattcttttaccgaggaagagcttcagatctaccggaaagtccagcagaagttaaacgaaggttttatgctggacgtgaaggacagccgggaatttaataacgacctctccctgagggccaaaaagacaagcccggcaggtgaaaagaaaaaaacggcgcacagctgatatcatttagctgtgcgccgtctctttagctgagaaacacgtattcattcagccgctggaaggcctcttttacctggcttaagggaagggccagattcaggcggatgtggtacggtccgtgaaacatctgtccgtcctgccaggccacacctacggcccagccggcccgctctaactcctcaatggtctttccgttttcttcacaccaccggctgcagtccaggaacatcatataggtgccttccggttttgaaaggctcactccgtgaaaatgctccctgatataatcataggcgtaatccacattggcggtgatgacctggcacagttcgtcgacccattcatagccctcggaccggtaggcccctaaaagggcatgcatggacagcacgttcatgtcgttgtaatgggataaggaggattcctttgccacccgctcccgaatccatttattgtagataatatgatagcttcccacaaggcctgccaggttaaaggtcttggagggagcgtataacgccaccgtccgttggcttgcatcctcgctgacgctttgggtagggatgtgctcatggcctgccaaaatgatgtcggaccagatttcatcggaaattacaaagacattatgctttttgtaaagctccatggctttctcgatttcccatctctcccatacacggccgcagggattgtggggagaacagaagatagcggcatgaatctttttttccaccagttttttctccatgtcttcaaaatccatgcgccagatgccgcccacatccagttttaatggactgtggacgatgttgtagccgttgttttccacgcacatggtaaagccgatgtaggtgggagaatggaggagcacattatcacccttggaacagaatacgttcaaggcgctgattaagccgcccagaaccccgttttcgtagctgatggcctcctttgtcaggccggtgacgccgttgcgcttctcgtgccagctgatgatggaatcataatactcgtcaggcggagtgaaatagccgtaggccgggtgctttgccctttcaatcatcgcctccggtatggtggggacagttggaaagttcatgtccgctacccacatgggaatggcgccaaagccctctcccggcggctccggggtaaaacctgggttcgtccccagtccgtcaactgcgatggaatcctttccgtgccggtccatgatgctggtaaaatcgtatttcatagtaacttatccatcctttctggctatatctttttaaattatatttttaaactatattttgacagaagcggccctcgtcatgcctcttcgtagctgacctccacatgcgcctgtttgctgcggaggaaagagaatacaaaggaaccggcgatgactaccacgtttaataatattaaagttgtagataaggttgaggcattgagaataatcgcaaaaattgcggaagcagctccaagagccgtaatcaatgtcatggcgctttttccaaccttaaacttagaattttcccatgcctccgggcagaccttgggtatcttatagacgcatatgttaatcatcaatgtaatgaccccgttggcgatcaagcacatattgcctaagaccgcaacgcttaagccggtcagaatgcagaccgcggcaaccaggtagagaatggtgaggatgatgattggagtgttgtacttggatagcctggcaagccttgccggaagccagccgtcatcgcaggcctgcatgacgggcttgggggcccaggcatattgggcgtttaaggtggagatcagggcaaacccggctccgcatacgatgaaaaatatgtatagaggacggcttaaaatcttatccgccaccagggttaaattctggcctgccacctgttccagcggaagcactcctgccgctacgaatgcgatgatgccgtaaaggactgccaccgccagtgtggaaatgatcatgaccagaggaatgtccctggtaggccttttggattctgcagagaggttgacgatgcaggaagcgcctcccaccgcaaaggtgagcagcccgcctgcctgcaaaagcccaagcatgcctcccgtcataaaggtggattccgcaaagtaccctggctcaatgtcccccacgccaaaagctgcaaacacgcctaaggccagtatcagtcccatgacgatcaggttctggatccttgcgaatttgtcaatgccaaagcagttgagcacatagaagagagtcaatatggccagtgcgatcactttctcattgccaatgccgaacaaagagatgaaatagctggcaaaggaaagtccgtacatggagatggataaattggagaaaataaacatgatggtataagcgcctgcgaatttttctcctgtcagcatggcgaccatggtatactgccctccccgcagacggacggtgcccgagatcaggattaccggcaaatactggcataccgtgattatcgctgccaccagaaaggccagaggaaccgagcggccggtcatggctatggccgcgcccagcagggtcatgatgcctgcaccgatgatctgtcctacggaagctcccattagatcccaaaaaccgagtacctgttttaattgctttgtagagctgctgcattgtgaatctgacatagctataccccttgagtatgaaagtttaaaatgcgcatgtattgtaaaagcgggcccgcttttatccatgaaacaaaatactttccccgtttgcaccgaaaagacttatttatccttccattgtcagattccttttgcttccggcgcagcaatactgtttagctgttaatttataaacctgcttaactatttacatgataaatataattgtgtcttttgtcaataataagtttttcgtattttattttttgtatatagtgcataaaatttcctcgtttttttcatgaaagctcctaataaagaagcagtcatcggctgcctggaatccggacttttccggtttgccttcttttccttacctgtttcggtaaattcattgctgtattataagatcaatccagaggcaggcagaggggaactctgcaagcatggaatggaattctttcaaaataatgaatatggtggaatgttatacagtttttatggtataatcatagccagacaataacaagcccatttgaggtacaaggttgaaagaaaacgtggttcaaccttgagcttgtgaacagcgtgccctgctttaccgggcacagggcgccccgtttcattgggcgtcaactgaatatgcaggcatatccgcttgattcattaggagacataatatgaaaccacatgcatttgcggtctgtgcatataaggactcgccctatcttgaagcctgtctccgttctctcctgaaacaaagcgtcaggtcagagatcatcatatgcacatccacgcccagccctttcattgaaagaatggctgacaagtacggaatcccgttgtttgtgcggcatggagaaagcaatatacgggaagactggaattttgcttatgaccgggcttccgcccgttttgttaccattgcccatcaggacgatctataccagaaggattatgtaaagaagcttctggagagctatgagaaatacccggatatgacgctgtttacgggggatataccgtgatcaggggaaaccggccggcagtttttgaaatggtggagtttattaagcgttttttaagaattccccttcgtttccgctccatcagccatttgtcctgggtcaaaaaaagcgttttgatgtttggaaattccatctgctgtcctgcatgcgcatataataaggagcaattaggagagtctctttttacctctccttatcgttttgccctggattgggataccctttatcagctatccgggctgcccggccgttttatctgcgtggaaaaaccgatcctgtattacagggtccacggagaagcgacgacaaaagcctgtattgcggacaaaagccgtatcagggaagaaaccgatatgttttcgaagatgtggccaaaaccggcagtaaaggtgctgatgcatttttaccggaaggcttataaggaatatgaatgaacggaagattaggaggataaagcaatgaaggtagtattattagcaggaggctttggtaccagaatcagtgagcagagtcatttgaagccaaagccaatgattgagatcggggaaaagcctattttgtggcacattatgaagtattattcccaatatggatttcacgattttgtcatatgccttggatataagcagtatgtggtaaaggaattttttgcggattattttcttcatacatccgatgtgacctttgatcttgccaacaataagatggaggtacataataattattcagaaccatggaaagtgaccctggtggatacggggttaaataccatgaccggcggccgtataaagcgcattcagccttacatcggggatgagccctttatgatgacctacggagacggagtctgcgatgtggatttaaagactttgttggagtttcatcagagccatggaaagaccgctaccatgaccaccgttaatattgcccagctaaagggtgttctggatattgatgaaggtgatgtggtccgttccttcagggaaaaggatgaggcggacaacagcctgatcaacgggggcttcatgatcctgaatcctgaaatcttttcctatttaaaggatgatgccactgtgtttgaaaaggagccattgcaaagtcttgcggcagaggggcagcttatgagcttccatcacaccggtttctggcagtgcatggacacccagcgggaaatgaagaagctggaagatttgtggcagtccggacaggcaccctggaagatttgggagaactgatatgacaaattggacgagtatcaagtggagtgaattttgtgatttttataaagggaaaaaagtcctggtcacagggcataccggctttaaaggaacctggctcacccagctccttgttaaggccggggcatcggtaacgggatattctctgacgcccccacggacccaaacttatttgaagtggcaggactttcccgcgttatgaattctataatcggagatgtgcgggacctggagcatttaaaaaaggtgtttttccaggaggagccggaaatcgtgttccatctggctgcccagcccattgtcagggactcctataaggatcctgtttatacctatgagacgaatgttatgggaacggtcaacatactggaatgcctgcgcctgaccccttctgtcagatcctttttaaatgttacaacggataaagtgtatgaaaataaagaatgggagtatggataccgggaaacagaccccttagatggttatgatccttattctaacagcaaatcctgctccgagctggtaacccacagctatgccaagtcctttttttccgacggacgtgcggctgtttccacatcccgtgcaggaaatgtgatcggaggaggagattttgccaatgacaggatcattcccgactgtatcagagcggcagcagcaggacaggatatcattgtaagaaatcctcattcaacaaggccgtatcagcatgtgctggaacctttggccatttatatgaccatagcaatgaagcagtatgaagattcaaagttccagggatattataacgtaggtcctgatgacagggactgcgtgacaaccggggagctggcggatttgttctgtgaggcatggggccagggtatcaaatggatcgacaagtttgaaggaggccctcatgaggccggctttttaaagctggactgctccaagatcaaaaaggtctttggctggtatccccggtatggggtgaaggaagcggtggaaaagaccgtggaatggaccaaagcctatttggatggggcggacatgccggcatttatggaccttcagataaaagagtttttcaattaaaatgagtttgagaggaagcacccttcgggtatccctttatgcaaaaatacgagcaggaatgaggaaaataaagaatgtttgagaacaagacagaaaaagaggcacgggaggaaatcctttctctggtaaaggaatattgcggtacttaccacaacaagaaagacccgtttaaggaaggggaccgtatttcttacgcttcccgtgtgtacgatcatcaggaaatggtgaacctggtggacagctctctggagttctggctcacatccgggcggtataccgatgaatttgagaaaaaactggcgcagtatttgcacgttaagttctgttctcttgtaaattccggttcatcggcaaatctggtggcatttatgacccttacttcaccgcttttaaaggaacgccagatcaggcgcggtgatgaagtgatcaccgtagcggccgggttccccaccacggtgacccctatgatccagtatggggcagttcccgtatttgtggatgttaccattccacagtataacatgaatgtggaaatgcttgaggcggcacgttctgaaaagacaaaagcagttatgatcgcccataccctgggtaatccctttgatctttctgctgttaaggcgttttgcgacaggcatcagttatggcttattgaggacaactgcgatgccctgggaacaacctataccataaacggagaggagcgtttctccggcaccatcggtgatatagggacttccagcttttatccgcctcaccacatgacaatgggagagggcggtgcggtttataccaacaatcctttgctgaataaaattatccgttccctccgggactggggcagggactgtgtctgcccttccggacgtgacaacttgtgcggtcaccggtttgaccgccagtacggggagcttcccgtgggctatgaccataaatacgtttattcccatttcggctataatttaaaggcaactgacatgcaggctgctgtaggctgcgcccagcttgagaagtttccatcctttgtggagcggagacgccataattttgaccgcctttataaaggacttgaagatgctgccaataagctcatccttcctgaggcatgtcctggctccaagccaagctggttcggctttttgataacctgtaaggaggggtaaacaggaaccaggtggtgcagtatgtggaatccagaggaatccagacaaggatgctgtttgccgggaatttaacaaaacatccctgctttgaccagatgagagggtccggggaaggatataggatcgttggagaactgactaatacagaccggatcatggaggataccttctgggtaggtgtatatccgggaatgactgatgaaatgatcgattttatggcaatgaccattaaggaggcgctgagcctgtaggaagtatagggtatacctttatgcccaggaagcgtgggcaggaaagaggaaacatgagggaatacgatttaacggaggtacatcaggcgaatctggctattttaaaggagattgaccgtatctgccggaaatacaagattaaatatcttctggatgcaggaacacttttaggcgcagtaaggcacaaaggctttattccctgggacgatgatgcggatgtggcgtttacccgttccaattacgatgcctttttaaaggtggttcgccgggagcttccggaagggctggagcttcttgaaccaaaggatttgagaggcggaactggtttttatgactttacggccaggatcatctataaaaacagccggactcatgaagattcggaagagatgaggttttatgaaggtaaattaaaccatctgtatgtggatttattcaccattgatgaacttcctgaaggcaaagcagcctcagcgtttacccgtcttcttcataccgtgatctacggtatggctatgggtcaccgttaccgtctggattttaagaagtacagcctggtcaataaaatcgttatcggcgtactgtcctttgttggaaaaatgataccaatgaaagttttaagaaagctgcagcacaaggcagcggtcaaagaccagacgggaaagagcggtcttcggtattacagcaattatcagccggattatctttatgtgacactgaaaaaggaatggtgtgaagaaaccgttgatctggaatttgaagatactatgctgatggctccaaagggctggaatgaggttctaacctggatctacggggattataagaagctcccgccagaggaaaagcgggtgccttcccattccagcatggaaattaagatatatcattaaaatagagctgcaaagagagtttaaataaaagatgcgcatggagcaggctaataaaaaagccatttcaatgcgcatctttgtttttatcgttgcttgcagttgttttttgtattatgtttgcatctttttatttctaaagatactatgctgtttgccttactatttattgttcaaatattcctttgcatccttaaagaaactgaaaataattagaagaatgataattcctatgggaaacgctgcaataatggaaacggtttgcaaattggccatggaattctcagaaaatatgagagcaatgggaaacagcattaaaagcacggaccagaacagctttacatgcttatccggctcctcatcctcaggaagctccttgtaggaataggaggaagcgacgattgccagggcatcaaaggaggttgcgtaaaatgcgatcatggtgagtgccaaaaggatcagccccagctttgcaaagggcagagtctcaaaaatggccataatggtctggtataggtttccggttgatgtgtaaatgcccagcacatccagcactcccttggtttggagagcaaggctgtaatttcctaatataataaaggaggtaaaggttccggaaagtccaaagatatatcctccgagtatggtctgtttaatggtacgtcctttgctgatggttccgataaagaagggggtcgccacacaccataccatccagtaagcccagtaaaagatggtccagttctgggggaaggaagaggttcgcagggcatcggtccaggtggacaggccaataaagttctgggtcaggtttccaattgccgtaattcccgtttcaatggtatatctggcttctccgccgccgatcagcacatagaggagtaagccaaagaataagtaggtacaggaagccgccagttttgcaacccctttcatcccatagtaaaccgtgaccgtgtaaacgatacagatgatgaccaggattgcaatggtcagcagcctggattccggaagtccggttaccctgctgacagccatggaaaggaggggagttgccagagaaaaggtggttgcagtaccggccaataaggcaaatactgcgactaagtcaatgagctttccccaaaatccgtctacatggcgtcctaaaagcgggcggcaggcttccgagtatttttgttttgtccgtttttttacatgaagcatgaagccgaacgccgctgccagtatcatatagaagctccagggaatagggccccagtgaaacagcgggtaggtggaggcccaatcctgcatggtgcccagatctgtaatatggggctcccctgcatagagaatccattcgcaaagggaatagaacaggatgtcagcagccagaccggcggtaaacatcatggtaccccatttgaagtttgaatactggggcttttctaagtttcccagcttgatggaaccatatttggaaaacgcaatatacagggagcacagaaaggtaaaaagcccgataataagatagtagcttcccagttcatcccccaagaatgcacggatagcagccagagtatttgcagacccaccgggacttatagtaaaaacaaggcataaaaggatgatgattataaaaggaatcagggttgttatccagtccagcttttttaacaaagcttttttctcattgtggtccatgtatgtaacctcctaaagtgttcaaaaagataagtttgataccaatattgaacataataccatggatacccagaaaatgcaagaattaaatgtgaagattttctgacattttgcataaaccactacaaaaaagagagcacatcagatataatgttagatgttcaataaggaggagattatgatgaagaacaaagctctaatgatatgcgcaatgtcggtgatgttgctgaccggctgtacgaaaagcaatattcttgcttctggaggtccggcggagcctgtttttgaaactcagcaagggattgttctggattggactcagattggaaatgatatggacgaggaatttgtggacaacgaaaattatcctatggcgctaagtgtcaattacagcgtggaccaggagaagaaaagcattgatttgactttgattgtaaaagaaggaaccactcccgaagaggcagtcacttttgccgatgcggcggttcggttcttaaatgatgaagcggctatgcaggatttttcctttgaaaaatcaagcgatacctcttacggcggatttttcaaggattatgatctgcgtcttatcgtaatgccggactacacgatgaaggaagaaaagtactggctggtggatatggacatccctaagggatctgatgaaaaaattgttccaaaggaaggtgcagttatcatggagcctgccactgaggatcaagaggcagatgaagagactgaagaaaccgaagagccggagtcagaccaatagtttgcagagagcggaaaaaagaaacatggatgaggacgtggtatgaaaaccgggcctcagccatgttttttatttatgcttgttctcatgtatacggttatgggtcaactgacagaccgctgtggtaggaataattgccaagctcttttaaaagcttattgtggtccaggctttttaggggaccgttgaggtcagttcttcgttcagaagatagaacacgtcactgcatttggccatggactggtggaagagttccggaaaggaggcctgggaggcaaggcggcggttccagggattacaccaggtttcatggtttaaattcatggtgacaacaggatccggcggaatgtctgtaaccagcttccgggaagcaaggggcgtgcgcagaaaaagagattccatgaattcaatgctgtttttcttgcggctggagggatctgcaagggtccggcagcctaaacgcatcgccagaatggaccgggataccatcttggaggttacccggaagttatttcggtagtttaacgggtagtaggcttcgttgatgcatactgacaaaaagctggagatgaactgcatctcctggccgtttaagcagatggtggcggcctggttaaattgagatggctttttccttttgtatttcattaatagcagtgcatcaatatcattttccagcatggcatgtagcccgtgatgatagttgccggagttttttacgtcatattcgatcctgccgtacacgtaagggtggcagatggagtcgccgatgtaatggcagaagtagccgctcatataggaaatggcctgctctctttgctgcttggactcgatttgggataaatggtttaggcaggaaacaaaaaaatcgtgtacatggttttcatgcatataggagcctacgttgcggtaatccctgtgacgaagaatgggtatattgtaaaaaaacatatccggtccctgaaggcctagctgatatagccagcggtatttggagattatacgctttaaaggggtgttgggcatgtcattaaaaactttgactcccagcagatagtgagtggtaaaaccgggcatattgttcacctcgtattttttggggggtgcagtgcagctcgtggatacttattgtagcacgcgagtccgcagtgcagctcgcgaatccgcagtgcagctcgtgaatccgcagtgcaactcgcgaatcctgcggattcgttcgctcacgggcattcgccctatgaattagaacgcaaaaaaattttcttacgtgcgggcacgacgaaaatttttttgtgttctaattcgcactgctcattgcttatatgaagattataccacagtcaattttattttgtataaaaatgattggaaattttcatactgggcggttgggacgaatatgtgttaaggagagcgttcaggagctgatcttatgatacatcgtgtacatgaactggtatgggggccgtggcttttggttttgtttttggggaccgggatcttttttacggtaaaaaccagattttttcagatcagaaaattccctttttggtggaaaaagaccattggaagtatacaggaggatgaggcggaagataaggggaagtgacgaaattccagacagcctgtacggctctggcagctactattgggaccgggaatattgcaggtgtggctaccgcactgacggccggcgggcctggagccatattctggatgtgggtttctgccgcaatcggcatgatgacaggttatgcggagaccatgctggggatccgttaccgttacaaggaccgaaacggcgcctggatatgcgggccaatggtttatttggaacgggggcttaagcttcctgtgcttggcatgatatacagctttctctgtatcatggtttctcttggaatggggagcatggtacagtccaattccattgcggaaactcttgaatactcctttggccttccgccggttcccatcgggattttgcttacgggaatcgtgttattggtgattctggggggatttcaaggattgcttttgtttccgaaagactgattcccatttcagccggagcctatatgctgttttccatggttgtgatcatgtcctgctacgatcagattccatacatatttcaatgtattctccaggatgccttccgcccggtatccgtcttttccggggcagcaggctatcaaatcagcaaaagcctgcaatacggcgtatcaaggggagtattttccaatgaggcagggcttggaagtatggcagtccttcacggcgcggcagaggatacgactccggaacagcagggaatgtgggccatgtttgaagtgttttttgacaccattttgatctgtaccatgacagcctttgtgatcctgtgcatgacggaaggggatgccgcgggttccggctatgacggggcggctttgacagcattttgcttttcaaaacgcttaggcaccttgggagaatatgtggtatcaggcgccatgctgatttttgcctttgcaaccatcattgcatggtactatctggggcgccaggctgccgtatatttagcggaaagcctaaaaaaacgcggatccttctatgtcttacagcgcattttaagaggaaaggtttataccctgctttatctgggggccgtattccttgggtgcctggcaaagctggagactgtatgggaattttccgatatctggaatgggctgatggcccttcccaatatcattgccctgttcttcctgatgaaggaggtaacggttcctggaaatacagaaagacaggcactgtaaaacatctgcctgtaaatggggagggggtctgaccaaaaacggtcagacccccttatgatgaaatacttgcaagcaaattgtcagcaatctccagtgtagtatgagataatgctcatgtaatcctttggagacggaatatccagtgacagacaaaggcaatttttattttccctgtacttatgcagcagctcgttctggattccatactgtttgttgatattttcttttctcccgtccgggtacagcaaattgaccgcgtcactgcacgaatttactgtctgtaaaaagttatccatattcaagacattcagttttaccattacaactcctccattgtaaaaaacagtggtcatatggtgacagcaatgaatttaaaaaaaagattgccctatcacccttacaggtatcattatagtgcaatctcacttgaataaatatattatttctgccgttatatatcattattctgccatctgcggcggtattccaggggcgtggtgccaatgtactcccgaaagacctttccaaagtagctgctgcttcccaatccgcatgcatggcttatatacgtaatcgtttccctggtgtttgccagcatttgacaggccatttgtaaacggtaggttttcatatattccaccggcgtcatgtgcaggcagtcatggaatatccggaagcactcccgttcgctggaaaaagcggaggcggcaatctctggaattgagatcttttctccataatgctcatggataaagaccatcattgattttattttatcatttgttttgccggaatctcccttttcctttaacagggggcgggacacggcgagaagctgaatccagatgtcagataatgtctcccgcaattttatttcgtatccaaaatcattctcagaaagatgaaaagattcatgaatggtatctaaaatttttccctgtaccgggtcactaggatatagtgcgatgatttcaatctgaggggctgcggtgattggagtaacgtatttttgctcgatgcggcttccctgctgcccggctatgaaagaagggtcaaaaagatgaaggagctgaatgtttttttctgattccgcctgaggccttgccatgtgaagcacattggaattgaccattccgccggaacctgcgggaaatattaccgttccttttggcgtacaatattccattttcccgctttccatgtagaacagttccacgggtttatgccaatgccacggaacaaaacgtcccatgaattgatccaattgggagcaggaggcaatgtatggaaaatcaggtgtaaaatcaggcaacaattcttctttgctccctgtgtggaattctattctatgaacgttcttcaatgatgtttcctcctcccgtttattgaaacaaatgacattatgaatggtttttacaaagttttagtaaaataatatcgttttcctgttacaggatattcttctaatgtaaacacatttttgtacccctgcttttcatagaagacagacgcctgaaaactgaacgtatccagaaatacatactgacatcctcgttcttttgccgtttcttctgcctgttttaaaagcttactgccaatttggctaaattatagctcaataagccctggtaaatggtttccttatcttcttcttctttaattttgccggttatttcaaggttcataaaattgcttctccttattggctcagggtttccgtttgcagttatcataccatacgcatggacacaataccacagttcatgtcaggagtggattgaaaggttctgtgtatatggtgaaaaaaaccggcaaatttaagcaaagattatcaagaattaattctctggagagtatataatgataatatattttgggaaaggagcaggtatatggattatcattcaaaagtgcgggattcacttaactatattgaggagaatttaaacagcaagatcgatcttgacgatcttgcaaaaaaggcttatctgtcaaaatatcactatcatagaatttttcacaaactatcaggggaatccgtttccagatatataaccagaaggcggatggaaaaagccgcggaagagcttatccggacagaaaagccgatcattgatattgctctggaatatcagtatgcttctcaggaatccttttcaagggctttttttaagatttatgggctgacgccggggaaataccggagaaggcatggcatcaatacagatgatgtgatcagtctcagcagccgctttaataaaatcacaaatatggccgcataaacggcccatggaggtcaatatgaacaatcttatccccatggtaattgaacagacaacccacggagagcgttcttatgatattttttccaaactgttaaatgaccgtattgtcatgcttaacggctcggtgacaaatgacacggcaagcctgatcatagcgcagatgctgtttttggaatctgctgactgcaataaggatattaacttttatatcaacagtcccggcggttccgtaacggatgggctcgccatcatggataccatgaactacatcaagtgtgatgtttccaccatcagcataggccagtcgggaagtgcggcctcattgcttctggcatcagggaaaaagggcaaacgctttgcgctgaaaaacagtgaagtgctgatccaccagccgtcaatatccggcggcctgcagggacaggctacggatatcagaatccacagtgagtggcttgaaaaaacaaaaggaaagcttaatgagatatactgcaggcttacaggccagccgctggaaaagatccaggaggatatggaacgggattattatatgacggctgagcaggcaaaggaatatggcttaatagacgaaattttattattccgaaaataatacctgaaaatgaatgaagtcagcccgcttacacaaggccggatagggaatccgtgagcgggcttttgtcatcaatcatctttactttttcgactcgtcccatcaattcatagtaattacgccattcctccagtgactgcaaaggaactgtaattccatggacctccgtgtgatcatggatattttctttttttaaagggaaatagtattccttatctttgctgacaatgataaaaccagccattgcatcaacatcaacaccgtcaacattgaattccaggaagcattttgttttatagccggtattaggagcaggcggctgaagatttcccaaagataataaaacaccttttaatgtttcctcatcttcctcggcaaccatgatgtctatgtcgtgaaattcccttgtgatccctttgaaatataacagcacagaggctccgacggcccatgtgacatttttctgattcagttcttttgcaatacgtgacagtacagtcaacttcttttctatagtttccattcctttacctcgttaaatttttgttatttccggcaagctgcattcaaatgtttgactaaagtttaccacatgtgctgttaaaaagccatttgattcatgtgaatggcgaaaatgggctgtgaatgagatatgcctctgaccttatgcaggaaatgaccggaaggcataacagaatatgtcaggtaaacttgacatattctttcaaatatcatatactggttgtaaggttaacattacattcagaaaggggaattatgaaaaaccgcataaaggaattacgtgagaagcttggcattacccaggagcaattaggacagcttgtgggcacttcccgccaggctataaatgcattggaaacagaaaaaaatgaaccttctatctggctggcttatgacatcgcacaggtatttcatgagccgattgagcgtgtttttttatttgaagaaagtgaaaggaaatctcgtgcagatttaagtagaggtataaaaaatggcgttgagagagatcagaacctttgatgacagcattttaaggaaaaagagcaaaccagtggaacaggtcaatgaccggatacggacgattcttgatgacatggtcgaaacgttacataatactcccaatggcggggcattagctgccaatcagataggaatattgagaagattagttgttattgaccttggagatggtgtaagaaagcttattaacccggaggtcttatccgcacaaggggaacaatttgagccggaggcctgtttaagctttcccggctggtggggaaggtccgccgtccccaatctgttgttgtaaaagctttggatgagaatggctgtgaagttgaaatacatgcttctgattttctggcaaaatgcctttgccatgaaatagaccacctggatggaatcgtatttattgataaggcagaagaattgaacgaagattgatttttatttattctagctgttatggcgtcagatgggtgaatatgaaaatacaatgaaggtgcggttcctggatgcggaaccgcaccttctctgtattagtgtgaaaccgggaaactaaaaaacacccgggtttattgcggattgaccggaaaactatatggctgctgtaaatttattgttcttataacggatcatatgatctgctgcctgcggtattccaacggtgtcacatgataatggcttttgaatttacggttgaaattggacagattgtgaaatccgctttcaaaagcaatatctgaaatagataacccggttgcccttaaaaggcttgctgctactttaaggcggtgctggattatatattccgcgcaggtaattcccacagtctgtttgaaaaagctcatgaaatgggttttgctgaaatagcataaatctgccaattcacagacagaaatggatttctgataattctcctgaatatattttactgctttttttaccttatcaacgtgtgcaggaatgggaaccgcagtatccggatttgtaaagcactgatgctgaaataacagataaaaaagatggtgtaatttttcctttagggccatttcaaaatacatatctttattttttacacaaagaaagatctggctgatgcaatcagagaaatccggatataagggatgatcctggctcatatgggaaagagggcgaagaaaaccgctgtatatgggatgaagataagccaggctgtattggtccataagagaatatcccagcatgtccagatgaaaaaccaaggtatcggaaatatgggtgatgccaggcaaaggctggacagaatgcagtgtgttaggagccacaaagatgaaatcccctttttgggattgaaaggtttcctctccgattttataaatggcgctcccttctaaaactagagttatttcagcttccacatgccagtgaagcaatacgtcaggcaaaaccgtcggcatgatacagtggtaatgggcatagggtgaaaggatggttccatggtttacatcctgtttttgagatgacagcaaatagggttccaaaacaaatccctcccggatttaaatgagactacaataagaacatcataggataatatcagattttagtagtattatataggaaaatacttatataccatgttataatatcaaaacatcaaatgaaatgcaaaccattattacaccattttgccgcccttttatcctcacttgctctgcaagttcagataaactatattgcaggaggaaccatacatgctatctatattacttgtcattatctacatatcctttatcagccttggattaccggattcgcttcttggatctgcatggcctaccatgtaccggcagcttcaggttcctctgtcctatgcgggtattatttctacgattataataggaggcactgttatttcaagcttaaacagcgaccggcttattaaaaattcggtacaggcaaagtgactgccgtcagtgtgggaatgactgccgcagccttgtggggattttccgtttctccctcttttccggccctgtgcctgtgggcggttccttatggattgggagccggctccgtggatgcagccttgaataattttgtggctcttcattacaaggccaggcatatgagctggcttcattgcttttggggtgtcggggcaacccttggtccttacattatggggcatttcctgaccgggggcatgtcctggtccatgggataccgttctgtttctattattcaaatggtattgactgcaatgctggtattttcacttcctctttggaggaaaagccgtcaggaaactgaggaagaaaccggggataagccgaatttaaccataaaagaattgcttaagcttaaaggagcaaagcctatccttgctgctttcttttgctattgcgccttggaatccaccactgggctgtggagcagcagctatatggtaatggaaaaaggaatttcaccggacacagcggcaaaatgggcttctttatttttctttggcatcacttctggaaggtttttaaatggttttgctgccatgaaattatccaataaagaaatgatccgcataggacagggaattatgatcctgggcatcctggcggtattgctggttcagggaaacatatttctgtgtgcaggattcattttgatcggaataggctgtgcccctgtatatccctgcctgcttcatgagaccccggagaattttggcaaagaattatcacaggctattatgggcattcagatggcgtgtgcttacgtgggagccgcccttatgcctcttttgatgggagttatagcagaatacgtgacgatccggctataccccttctacctgatgatatttgctgtagttatgatcatattggttgaacgggttaaccggattaagaataaatagatagaaaggcattttataaatatactggtatgggactaaatcctgtgataataaggtttgcataggccagaagcaatcaattttcccaataattctgtgtgggcaaataaaactgctgtatatcactggattgaagctgagcttcgaagtgatcagatcccgttgcatgtacagccggcatactcaacacaaggccgtcaggcttaagaaaacaggaaacattatccggtatgctgaaagggtcagctgtttgatattccggcgactgcagcttaagcatttccggaaaacttgcttcatcatatgaggttaccggatccgtggggaagaaagccttatcaaaaaacaccttttcaaaatctgcatcggttgtatataaatccttgagcgtgatctctttcaaagactgaaggtctatattaagaggaatcaggttactggcaggatatgcactgctttcagcataacccgatccccaaaaaacaatgctgattattttactgttttgcaatgtaactgcggactgatagtcaatggttaagccggtatcaccggagaatagagatgtatcaatttttgcaaaactttgcactttatcatagattaatgtgtttaacgcatctgaatcattgccggagaaacttggatattgaatttttatagtgctgtttttattgggtacttctgtatacagtaacattttgtaatctccggatgaagatttaacactgctcgtctgatcttctgaaatgattggactggaagatagctgtaacggtttttcgcttgatgccaaagaagaagcagattcgttggaagaaggttcggaactggctggtgtagtgaaagtgcggctgttgttttgggaacaggcactaagtatggacagaagcataaatgagagcaggacaacaactgctctcttagaataatggaaatgtttcatggcagcctcctaagttattgcatttattcaacattatacattaccctccctcttattgcaattatgggtaaaacgaaaacaaggaaaggccggcttgttcttggtaaagaaataagagttcgttcaaacaatgtctgcggaaatgacttgtaccccgccatttgagaaagtataatataggatagaaatggggacgctatcagaataaaaagtaaattccaaatatatgcaattctgaaagggggtggtcttgtggacaattataaagaaacacccaatagattaatcaaagaaaaatctccctacctgctgcagcatgcttataatccagtgaattggtatccatggggggaagaagcatttgagaaagcgaggcaagaagataagcctgttttcctatctattgggtattcgtaacttgtctgctgtagttgacttgtcattggtgccatgtaatggctcatgaatcttttgaagaccaggaggcggcggaggtacttaacaagtattacgtggccataaaggtggacagggaagagcggccggacattgattcggtatatatgtcagtctgtcaggcccttaccggttccgggggatggcctcttacgatcattatgacgccggaacaaaagcctttttacgccgggacctatctgcctaaatattcaagatggggctctgccggactgctggatgttcttgcctccatcaggaagctttgggaaaatgagaaaagcaggctgctggaagcaggagatgaaataaccggatatttgaacaaggaagaaactccttcagaaaatgagggaaaagaaccaggaagggatttgtttttatcggcggcaagcttattaaaacggtcctttgatgagaaatggggaggctttggaagtgctcccaagtttcccatggcccacaatctgattttcctcttaagacatcattattttgaaaaggataaagacgctcttctggcaggggaaaagacccttaggcagatgtacaggggcggaatatatgaccacattggaggcggtttttcccgctattccaccgatgagaaatggctggtaccccattttgaaaaaatgctgtacgataatgcactgctgctttatgcctatacggaagcatttgccatgaccggggacagcctttacgccggggtatcaaggggaattatccgctacatccgggaggtgctgactgatgagcagggtggattttactgcggtcaggatgctgacagcgaaggtgttgaaggaaagttttatacctttcaaaaagaagagatcaaacaggttcttaaggatgatgcagaagaattctgcaaatggtttggaatttcagaaaaaggaaattttgaaggaaaaaatattccaaacctcattgaaaatgagaattaccatactggaagcaaaatattagaagatttgtgtaaaaaactttatgattaccggataacaagaacagtccttcacacagatgataagatactgacttcctggaatgggcttatgataggagcacttgcaaaagcatatcaggttctgggagatgactggtgtctgaatggagctaaggaatcacaacagtttatagagaggaatctgacctctgataaaggaaggctttttatccgctacagggaaggccatgcagttcacgacgggcagcttgacgattacgccttctatgcctttggtcttttggaactttatgaagcttcctatgacataaggtatcttaatattgcttctgaaatatcggaaaagatgctggaactgttttttgatgaggctaaaggcggcttttatatgtatgctcatgacagggataagctgatcagccggcccaaagagctatatgatggagcccttccctccggaaactctgtggcagcctatgtgctggaaaaactttatcatctgaccgggaaaataaaatggcagagcgttcttgaaaagcagatttcttttttgacacaggaggtaaagaaaagccctgcgaactattgtttttcgctgctggcatttcagggaattctttatccgtccactgaaattgtatgtgtttccgctgaagattctatattaaaggaaatacaggacttacaaaagatccggacgccggagatgagtgtgcttttaaaaacgcctttgaatgagaaagccctgtcagatgctgctccttttacagcggattatccggtccctcctgctggcagtaattattatatctgccgtaacggagcgtgtatgaagcctgtagaaggcatagaggaattaaaaaaagcgctgcagtccctataattgaaagcctggaccagtctgccccttggcagattggccgggcttttgtttcctcttattttacatacataaaaattacaggctcccatataaataagtaagcagtttacaaaatgggaggtagtttgtatgtgtacagcactcaccttaaagtcccggcaaggagagactttttttggaagaaatatggatttttcttatgatattgaccctcatatttacattgttccaaaggattatgaatgggataatgttttaagtatggaaaaaatccataatgcctacagctttatcggtattggacaggaactggaagaaactcttgctttctttgacggggtaaatgaaatggggtttgcggcggcagccctttattttgccggttatgcaaaatacgatgccatgccggaggccggggcaagggaacagatagtatcctttgattttcttcattatattttgggaagatgtgcaaatatcaatgatttacaggagatgctaaaaaatatctcaatcgtgggctttgaggatccggtaacccagactgttgcaccattgcactggatcgcggtggaccgcagcggtgagtgcgttgtcattgagctgacggaaaaggggatagaattgattccaaatccaatgggtgttatgaccaacagccctgattttcactggcacatgactaacttaagaaattacatgggagcgacgccctatcagcccgaggaggcttgctggggaaatgtccgattgacgccatttggacaggcgggaggcacccaacttctgccgggaggctttacatctccggagcgattcgtcagaaccgcttatttaaaatcatttattccaacacctcaagaccggatggaagcggtgatctcatgttttcatataatggaaagtgttaccataccaaaaggtgctgtcataacaaggctgaatacttatgattacacgaaatatacagccttcatcaacacagctacctgcgaatatttttttaagacctatgacaatatccaggtgggagcggcaagcctttttgaaagctgtatccaatttccggggcttgtgaatctggggggattatagaaggcagttaattacaaaacttattctggatcatatgggatgtacatagaaaaatggcgtattgcatggctgcccttaagagctggtcatgcaatatgccattcaaaaagttgtttcaaaaagggaggagagctgataataaattatcagctcgagtattatgaaaaaaaatcttataagcaatttgtttttacatttaaagtatatccatgaaacatgaagaaatcatgttgtttgtgtaaaaggtttttgaatgaaatttaaacaaagtatgaacgatgacacagtttcactgaaaattgagaagatttgttttctgcaggtaaaggaatagaacaaagaatgctttaataaccgtttttctttcacatttaatcgtatagaaggcttaaaaatccttccacagaaaacggacaatcttgtcttacgggcacttccatgatctgaaattgaggaaaaaatttttttacaagtgcagaaaaaatttgatactgcatatggggacctgctatggcaatggttcctgaagaatctttcataatctgagcgatcgcatccataacccctccatttaataccccttccatataagaaactctctgagccagagtggactctgcaaataagtccatgctgcggatcacgtagagcccgcggttaaagccatatttatgaataatttcatatcccatgcataccagttcaggtataatttcctcggctattcctccggtcagactggaacctaagatggtctcgctgacaatggcgtggaacaactcgcctgttatggtggaagatatgtcttcaatcctgccgtcacaaagaaacgctgtctgtgtatgggaacccggcagcactatgatgctgtggcctgccgccagctccggacagcggtgaagtatgccgaaaatttcaatttcctccccacgcatgttgtttgccagggcaacggtatccaatgaggcagtcacgccctgaggaagtgttttaaggcctgggacaatatgaatgatacggttgaaaaattctgtatcttcataagctgcaatgctgtcttttaaggttttgaaatccactggtaaggataagtgttcaatttcaaccatgccggaagaggaagaaaccataccggacatgtagatggcctggacatccttgtctccaaggttttcttcctgaagaattttatgatacagtctttttaatgccaacataagaaccgttctgtcatgctttagtgcggaatcccgtgacccaaccggaatgtctaccctgcgtatgatctgatggcaatgtatgaggtaggcacgtgtattagtcgtaccggagtcaaaataaaagtaatacaaggaaagcaccaactttcttatgatgtttttgctgcataagcggccgcaagtgagcggaccgcatcaaaattatgctgtgccaccgcctgcttgtctacaatgttggagccaatgccaacgcagcatgcacctgccagaaaaaatgaagtgatattttccagattcaccccgcctacggcagctataggaatatgaggcaaaggcccccggagtgctttgatataatccggcccggcagaatcggaagggaatatttttacgatatcggctcctgcctcataacattgtgctatttcagttgctgtaaaggcgcctggcatggaaagcataccgaggcgtttggtttcccggatgatggataaatccgaatttggagaaataataaaggcagcgccggcttcataagcggtgtaaagctgttccattgtcataacggtaccggctccaaataatacccggtttttaaattcccggctaaggctccggatcatgtttccggtgatgcttggaacagccgtctggtcaaaagtgacttcggcaaggccaagccctccggcatgtatggcttctacggttttacccgcatcatccagaccgagtccccggataatagtgataatgcggccgacccgaattcgttcaaaagttgtcatggttataacctcctgtcagcggataacctgattctgaatagtgttgttcttatataaggactgagtttgtaatactggaattattatagggcttttcacaggaatatgtcaatagctttttatgataatatgctttttataaaagaaaatgccggaagtatctcatctaaaacattataataaagtaaataatgcacaaataaagttattaaatttacttttttgcagttgacatacacaaagacatgggttatgatacatatgcgagctatataaggaactgagttctgtattacgaacaacaataataaggcagagaaaggaatggatgagtttaacatgaaaatcacagacatgaagctctattttatgcctcaccgttttcttctgttaaaggtggaaacagatgccggtatcagcggctggggagaaccccttgtggagggaagagcagctactttggagacctctgtgaaggagtggcgtgactactttatcggaaaagatccattgaagattgaggaacactggcagactatgtaccggtgtgctttttacagaggaggcccggtaatgatgagcaccattgccggtattgaccaggcactgtgggacatcaaaggcagatattacaatgcccctgtttatgagatgctgggaggcagtgtgaaggataaggttaaggtttacagaagcattcacggagatactccggaagaggtggcagcagatgcaaaaaaagcggtggaggaaggctatacggtgatcaagacttctccgaccgatgcgacccattatgttgatacatggagtggggtaaccaagttaatggaaaaggtaggtgccatccgtgatgccattggctatgatgtggatatggcaatcgatttccacggacgtatccataaacctatggcaaaggttctgacacgtgaactggaccagtttcatccgttattcatagaagaaccggtattaccaacgaataaagaagcgttgagagagattgcaaaatatacgtccgcgcccattgccattggagagaggatgtacagccgctgggattataaagagctgtttgagcaagggtatgcggacatcattcagccagacctgtctcatgcgggaggtatcagcgaagcaaggcggatttccgctatggcagaagcctacgatgtggcagtagcgcctcattgccccttagatgccattgcattttcagcctgtatccagatggatgcagccactcctaatgttgttttgcaggaacagagcatagagatccacgatgcaagcgataccaatccaagaattaatttcttaaaaaataaggaagtgtttgattttaaaaatggctttgttcagattccatcaggcccggggctgggagttgaggtggatgaagatctggtgatagagcaagataaaaaccgtcataactggaagaatccaatgtggaagacttatgacggaacccccattgaatggtaataaaaaaggaggaagaacatgagaaaaagaggttttgcattaggtttatcggcagttttaatggcaggcctgcttgctggatgcagcggcggctccccatccacagcatcggaacccagccagtctgaatcaaaggaaacggaaggtaaacaggaggatgtaacaattacatatatttcttccacgattctggagtctccggaaggagactttgaaaaaaagtgcattgaagagtttaatgcgctggataatgggattacggttgaagtggagggagtcagcgccaatgatctgatgaaaaagtatattaccctggcgacctccaatgccatgcctgactttttcctggcaaatcttttggacacaggtactattgtggatatggggcttgcagcagaagcggccccgatttttggagaggattacataaagggaattgagggagccagtcttgcaagtgccagcgtggatggaactgcctatgcaataccatggtttggaggggcttccggcgtcctttaccgcaaggatatcttcgatgaaaagggtgtgaaggttcctgaaacatgggaagaaatggttgaagcctccaaggctttaacaggtgacggcaattatggaattactctggtaggaacaaacaatggttccggtgccggcagatttcagtatgtactgcgtaattttggcgtagatgagtttgcccagaatgccgaaggaaagtggaccacagatattggttcacaaaaatacattgatgcattaagagcctatacggatttggatgtgacctataagactgttcctccgggagtgattgagacggattatcccaccgcagtgaacctgttctcttccggtaaggctgctatgctcattaccggctctaatgcaattggagcaattacatcccaggttccggagttaaaaggaaaacttggttccttccctgtaccggcagtagaacgatctgtcagcactcctggtggtttcggttattttattactccaggcaagcacgaaaaagagtcagcagaattcattaagtttatgttagaaaaagacagagaaattgaattttcagttatgacaggacgccttccaacccgaatagaggctcttgaagatcctgaaattaaatctatgccggaattagagggatttttaaaggcccgtcagaccatatatgagacaccggcaatcaccggttacagtgaaattaacgatgtgcacggggaagcctatcagtccgtatttacaggcgagtctaccgtggaggaagcggctgcaaaagctcaggaaagagcagagaaaatttgcgggtcagcaaacgaaggttaacaggaaaggaggccggtctgcttttcggcaggccggtttttcccgcgatatcaggaggtcgatggcttgaaccaagggttgaataaaagaatgaaccggttaaaagcccgtgtcactgcctatggctttgtaacaccggcggtcattacgttagctttattacttttatatccgttttgttatggaatttatatcagcttttttaaaacaaatcttgtaaataagtggaattttgttggaatcagaaattatattgccgttttaggagagtcaaatttttatgccagcatgaaaattacattgatttttaccgtaggcgtggtggcagggcattttatatttggatttttatttgcattaatgcttaaccgtgaaatcaaaggaaggactatcttccgtgctattttattgcttccctggctgtttccggaagtggttgtcgcaaacttatggagatggattcttaatcctactatgggttttttaaacagcgctttcgtctctcttggtgttttgcaggagcctatatcatggctgggatcccccagactgtctttggcagttttgatttttatctgcatctggaagggatatccattggtcatgattcagcttcttgcaggcttgcagactgtttccggcgagattattgaggcggcaagaattgatggggccaccaattttcagaccttctggtatgtgaccattcccagcatgaaatcaactttatcagtaaccctgatcctggatgtagtgtggtggtttaagcatgttaccatgatctggctgctgactcagggaggtcctaacggagctaccaatacaattgcagtggatatttataagagggcatttgaattctttgatttcgggccgtcttctgcgctggcagtggtggtatttctgatttgtgtggtgatcagtatcctgcagaggaggtttttaaaggatgaataaacagaataaacgtatcaatggattttgctacattggacttacctttggcagcctgattgttctgatgccaattatttatatgctgtctacatccatgaaatcgatcaatgaaatcatgaccagctcggcggtaactttatttccccaacggttttctgttgaggcatataagaatgtcattacggaatatcctttttttacttatctaaagaacagtgtttttatttccgttgcatcaaccttggctgcggtgtttttttctaccttggcaggttatgggttttcacggttccggttcaaaggaaaaggggccatcatgatgtttattcttgtaacccagatgtttcctgcagttatgctgtttgtaccatattataagctgctgactatttatggcctggctaacaccagaagcggaattgtgctggtgcatattgcaagtgtgattccgttttgcacctggatgatgtatggattttttaacagcatttccagagaactggatgaagcggcaagaattgacggctgcaatcattttaggatattttggagaattgtagctcctcttacattaccgggattggtctccactacgatttatgctttcatccaaagctggaatgagtatatgttcagcatgctgagcattacagcagaaaaaatgaagacccttccggttgccatcggccagatggcaggctatgataaaatcatgtggaatgaccttatggcggcttctctgctttccagcttacccattgtggtcctgtttattttcctgcagcgttattttatcagcagcatgacacagggagcggtaaaaggataattagtacttgtactataggaaaaaagtgtgtacaatatggtatattatggaatgagagaggggaatgaaacagtggcaaaagaggaattccatcgcgcaacccagcgtgtcatagagatgttggagcggctgactttaggtcctgcccagggaatgactctgacagagcttgcttccgaactgaacgcgcccaaaagcagcttgcttccgattgtacacacgctttataaactgcatatgctttcgctgaatgtggatacaggacgctattcgataggctacaaggcttatgaaatcgggaactcctatataagaagaggcggactgaccattgatatccagtcccagatgaagatgatcgtggaagcatgcggggaaacctgttattttgcacaactggtagaaggggatgtattctatctatacaaagtagattccacagaacctgttcgttccgtggtttcaccaggacagcgtcttccggcgtatgccacgggaattggaaaagcactgttgtcaggaaaatcaaaagaggaagtcatacggttatacccggaaggattaaaagcactgactccccatacgatcacagagatggacaggctatgctaccagttggatgaaatccatagaaacgggctggcgtttgagtgcgaggaatccacccagtatgtcagatgcattgcagttcccatccgccgcgatgaggaagtgatagccgctatgagtatagccatgccggtatttcgatacaacccggaaaaggaatccttagtcatcaggcttttaagagaagctcagatcaaactggagaggctgttaaaagatgccgatttaaatggaatcgtgatataataaaaaaccgccaaagtgcggttttttattatatcattgcattgaaatcaaaacatggcttttccatttaaaataactccgtccggttggattgctttgtggaaaatgcgggaattaccctgacagtcctcataggtttccgtatggtcaaggatacggaaaagggttgcattttttacattccgtaaatcgcaccagtcggtaagtcccaatgctttggcaggtccggcggtcactccgtacatgatttcctccaaaggaacaccgcagccgtataactttgagaggaggcagcccatatttttgaccagttttttgactgaggactgatgtaagtccgtacccatgagaaggtgtggaaggggatgctttaaggcattttcaaatacatgaaaatcaaaactgctgcttccatggccaatatccagccatacacctttatcaatcagcttttggagggctgttgaaggagtaccgtccgggttccagcagtccttacccctcccgttaaacacatgggtaataatatctcctttttcaaagtatggctccatgtcctttaaatagggcggatttccgcctgcatgaaccatcatagggaccccggccttcctggcggcctcacttgccagctttaagggttccaggccctcgtgccggattgtctcactgcccatgcgcaccttaacacctgtgatcaggtctatgtgatcccggataaactgggcacaacggtccccattaaggtactccatggcattgtagtcgtgatgaaatataaccccaatagggctgatgcataaaaatagtttatacttggtttgtatggtcggagcaacataggtggtaaagccatggtatgtaaactctccgacggttcctgcatccactaagagacaggtgccggtcttataaccgatgtcatcggcattggtgccaaacaggccgaaaccatcaaaaatatgtgtatgcatatcaatccatcccggacttaaaaaaaggtttgattctgctgggccgtcattcatgtggtcaacatgataagtctggtcttctccatgaagtaatccattgcagaattgatttctggaagcatcataataccggaccacttgggggtattcataagagggctcctttcccattaaaaactgattctctccaatatccacagagttcctcgtaaatactcatagtttttaaccttattcctttttttcggttctggccagatccagatagttataaagggtaaatcgtgagattttcagataatcacaaacacggtcgctggcttttgtgattaaaaaagcaccttttgcatccagatagccaacaaaacgtattttttcattacggctcatttcctccactgatttttcacttaattctgcagcctgtccaatcagaaaatcaaggacatcgctgatattaccggcaaatgtttctttttcctgctttttaggctctgcgtccggaatatagccgttatattgatgcagaaaaccttccatggcgatggtctgggtaatatcaagattaatgcacagagaaccaattgcccgtttgtcctcatcatacagaaacattgtggaggaacggaggatttttccgtctggtgtatgtaccacataattgtaacggtccccatcttttacctccccgcgaagcacttccaggccaaggttgctgccgcagtctcctacctttcgcccggtaatatggccattacgaatatccacaacggtgtgggcataatctttcgttaaatcatgtaaaattatttcacaccgattgccaaattggttttctaacatacttaataacttttgccagaaatcccaattatcataaatggatttcatataacacctccttttacttttataagctttgcaattgtctttattttatcatttattctaaatatggtcaaacaaaatgttttaaagataaagaaaaactttatatatatcggcaaataataaaacaaaaagtttgatatatactatttttgtcagatcacaaagaggaggaatctaaagcagcgcttttgaaaaagccggtaagtgtatgttttcaaatggggctgtacaaacccatgagtatttgataaaatatagccatatgcggaatctgacgcaaaaagtgcctttacaggcatacctttaagcccggagaatacgggtagggaagagaaaataccttacaggtatacctttatgccaaaatatatgggcaataaagaagaaagggaaaaaacatgaaaaatccggttgttacgattacaatggataacggcgatgtaatgaaagcagagctttatccggaaattgcaccaaacacagtaaataattttatcagtcttataaagaaaggcttttataacggactgatcttccacagagttatcaatggatttatgattcagggcggctgcccggagggaagcggaacaggcggccccggctattctattaagggagagttcagccagaacggcgtttccaatgcattcaagcattcagagggagtgctttccatggcaagagccatgcaccccgattctgccggctcccagtttttcatcatgcacaaggcatctccccatttagatggctcttatgctgcatttggtaagatcacggaaggcatggatattgtaaataaaattgctgatgtgaaaacagattacaatgaccgccctatgaaagagcagaagatccagtccatgaccgtggagacctttggagaagagtatccggaaccggagacctgctaagaaaatgacctgggaacaagaaatcacagtagaaggaaaagttttccaggttaccatatccgatgatcatgaggccctgcgttctgcttttgcggaaggcagggccatcgttggtttatgggacggtcaacgggcggatcagaatcttgcacctgcggcctatgtggtggaagctcctgaagacattgatgctggattactagaacgggtcgtccggagaaaagaggggcttccatggaatattgccagaaccaagaggctgttgatccgggagtttgtgcctcatgattttgctgctatgccggtggagtctgaggccgggatgccagaagctttatttttaaagaaagaatccttaacagcttacatcaggcatcaatacggcttttatgaatacggtatctgggctttggttgaccatagcacagggcggcttgtgggaagggcaggaatctgcaatttagaccttgacgggcaggaagaatttttagaggcagcaaaaaataatgataccccggtggaactgggatatcacatcttttctccatataggcggaacgggtatgggaaggaggcctgcagggcaatcctttcctatggtgccgcagctgtttcagagaggatttatgcaaggatccatgaaggaaatcatgcatccataaagctggcggagggtttggggtttcgctttattgcccgaacacatagcggatcagatccagggatgtgtctgtatgagtggaattgctcataactgcaaggatcggggtatctatggcgaggccggttttttcacagaaatccgtaccttccatgagaaggccgcaacctattttttctcctgtttcctgattggtcacaaaatagaggttttccttcaccttgtcgtaaaaatcggcagggaggagttcttttaagtccaaaaacccgcccatttccccgaaatggtctatggtatccggctttccgatcataacatccagtccctggctggatatcatggcggtgagtttggccagctgcgcataggtaaattcattcatggaggattcatcaaaggtgggagacatggagtagtccacatcgatctttgcatcctccttaaggccaatgtactgtcggaagccctggttaaagtattcatctacagaatcggcttcacctgttgggctgctgtttaaaatgacacaggaaagggcggtttcaaaccggttgttatagacggctgagccaatggaagagataaggatgattgccacgatgacgatgataatgggaatcctgtaatactcccagatgtaccagggtctgtcctttgggttcatactttttattttgttccgctcttcccgcagggtatcctttaggcttttttcctcgtatggggtcatgattcaaacctctttctttattaattgcaagtattattgattatattatgaacctggggttcatgatcaacattcaaccttcgcgccgaggagcaagctcctcttcgttctcttgcgctcattatatcatgattctacgaatcatgatcaacattcgccgttcgcgccgaggagcaagctcctcttcgctctcttgcgctcattatatcacacaacagaaaaaaatcattaaaataattataaaaatttagtgaaataagaaagaacgtttgcattttaagggcaaatccgttataatatcctttaacgccgttatgagaaggggaaaaacatatgttttctggtttttttaattatgataatccggtatggcggtttatcggtaaatttggagatttgattattttaaatatcctgtggctgatatgcagcattccgatttttaccatcggtgcttctaccacagccgtatattatgtgaccctgaaacttgcaagagatgatgatggatacaccatccgctctttttttaaatcgtttaaagaaaatttcaaacagtccacggtgatctggctcattctcctggccgtaggagtgatccttgggatcgatgtatacttcttcaccagattgtttacaggttccggggcattccggaccgtaatgcttacggtgttcctggcaatggttcttatttatgcggctgtttttacgtatattttcccgcttcaggccagatttttcaactcagtaaagcgaaccttttttaatgcatttttcatgtccctgcgtcatttgttccgcaccatcggaatgattgccattgacggtgtgctggtagcagctgccttcgtattcatggtgccgccgatgctgatgatattcatgctgtttggctttccgctgctggcgttcatcaattcctatatcctgtctcctgtgttcagtctgtacatgcctaaggaagaggagaggaatgatgatgagctgagacccctgtttgcagatgaggacgagcctgtaagcactattctcatggcaaagggcgatgagcatgagggagaagcagcagagaaagaagaatcagaagttcaaaaaacacaagactgacaggaataattcctgctgtcagccggacgggaccgctcatgcattcctgtccggctgtttttatggggattttatactatggacaccatatggacacaaaaaaaagatatacttaataactggacaaggaaatacctgggaggtggaatatgactgaagaagagtatctctgttttatccagccctatgaggatgcacttaaaaatatccgtgtcagagtggatgtgctgaacaaagattacagaaggaagaatcagaattaccccatccatcatgtccaacacagaatcaaacaaaaagaaagtattgagaataagctggagaagaacggatatgaggccagtgcggattcggccagaaactatctgacggatattgccggaatccgggtcatctgttattttgtaagagatatttatgccattgtatgcctgttaaagaagcagtcggatattgtggtcataaaagaatgtgattatattgcaaacccaaagcccaacggatataggagcttccacattgtttttggagttccggtctatcacactgacggcatggaatattatccggtagaaatacagctgcgcaccatgtccatggacttatgggccagcatggagcaccgtatctgctataagggggaaaagaaggaacgggcggcagaagaattcaagggatatgccctggccttaaggcagatggagatggagatggaagaattcctctgaggaagcaaaataagatagggcatgttccaaggctatgagtatataatccatagctttggaacatgctcttttattatgcttacagggcaccaaaaagctgtttagaaagttcccccggcagaatttctgccgggggattagggaagtaatataaatatgagaaaaagcggattatttatcgatccggaagcctgaataggcgttcatgccgtgttcatgtaaatccagaccgtccagctgttcctgatcggaaactcttaagcctatggttttcttaagcagagtaaagatgataaatgccgctatggacgtatagaccagaacagaagcaacgcccactaactgtgtcaggaaattgcatccctccccaaagataccggtcagcagtgtgcccagaagtccgcagaatccatgaacgcccacagcgcccacagggtcatcgattttggcttttttatcaatgaattcaatggcaagaaccactgcaaaaccagcaattactccaatgatgatggcttcgtagggagtcaccacatcacagcctgcagtaacggctaccagaccggccagggaaccgtttaatgtcatggatacgtcaggcttgccgtaacgcacccaggtaaacaggagagtggccagagtagaagcggcagcagccaggttggttgtcatggcgatgttaccgagagtggtggtggcagcagttgtggagccgcagttaaacccgaaccagcagaaccagagaatgaagacgcccaatacgcccaggggaatgttgtgaccgggaattgcgtttgcagtcccgtcttcgttgtatttcccaatgcgggggccgacgattttagctcctaccagggcgcagacgccgcctaccatatggactgcagtagagcctgcaaagtcgtggaatcccatgtcggctaaccagccgcctccccagatccagtgtccggttatgggataaatgaccacgctgatggctgccgagtagaccaggtaagaagcaaattttgtgcgctctgccatagctcctgaaacaatggtagcggaggtggcacagaatacggtttggaaaatcatgaatacagcaatgggaagaccgttgaataagccgtttccgtctgccagagaatagggattaaagaatccggaattgccgaaaaggcctgccacattgcctccaaacatcaggggaaagcccaggataaagtagaagagggttccgagaacaaagtccatcatgttcttcatgcagatgttccccgcattttttgcccttgtgaaccctgtttctaccagggcaaaacctgcctgcatgaaataaaccagaattgcggccagcatggtccaaataacattcagtaataaagttgtattttccataatcataactcctcctaatattttttgatggaatcattgccttcacaagaataaaaacaggggataaccgcttaaaaaagcaattatccccgttgatagtttatttccattctgtatgaaattaaatgtcagctccttctgggaactacaaagcctcccggccgtgttcgccggttctgatccgcactgcatcctgcacatcgtaaacaaaaatcttgccgtcaccgtaattgcccgtattgatttcctttactactgcatcaatgatgggatcggccagttcctttggtacaacggtttccaccttaacctttggaagcaggttcacattatatttggtaccccggtacatctgtgtgtaacctttctgattgccatatcccatgacgttgctgatcattattccgttgaccttgcagccttccaggatagccttcaggctttcaagcttttctggcttgataataatttccaactttttcatacagcgcatcctcctctattttgattacaaaaaaagggcggttccagttttggaacgcccttgttcagtatatcaacattatacacgacaaattttttctgtcaaataaaaatttaaaagagtatgagaaaaaattttgttaaaaattaacaagaacaagaaatatatatgagaatatacctcttgtactttttcttattttgttatatactaaatactgtatacaaaaaaataaaaaaatacaatccgaagaaataaaaagtgagggtgtttgcctatgataagacatctgggattaaaagcatacgggaaggttaatctgggacttgatgttttgagaaagcgggaagacggatatcatgaagttcggatgatcatgcagaccgtaggcctttatgataagattgacatttacttaaaagagactccgggaatcgaggttgtgacaaatctctattaccttccggtgaatgaaaacaacctggtttataaggcggccaaactccttatggacgagttccgcgtcctccacggtatccgcattcacttgaataagttcatcccggtttccgctggaatggcagggggcagcagcgatgcggcggcagttttgtttggggtcaacaagatgttccagcttgggctgacaagggaagaactgatggaacggggcgtaaagatcggggcagacgtgccttactgcctgatgaggggaacagcgttaagcgaaggaatcggagaaatcttaactccccttccggacatacctcaatgtcagattctcatagcaaagcccggggtcagcgtgtccacgaaatttgtttatgaacatctggatgtatctgccttaagaaaggaagatcatccggacattgacggcatgatcgaagccattggcaaccgcgacatataccagatatcggaacgcctgggaaatgtgcttgaaacggttaccattccggaatatccggtgatcgcacagatcaaggacaagataatagaattgggtgctgtgaacgccttgatgagcggaagcggccccacggtattcggcatttttaccagccccagagccgcggaaagggcttatgaagaattgagatacggcgagtcaaggaaccttgcaaagcaggtttatctgactaatttttacaataccagggaggttaccaatgagcaatgatttaaaggttaatatgaatgaatatctgccccttcgggacgtggtttttaatacgctccgtcaggcgattttaaaaggagaactggcgcctggagagcgtcttatggagatacagcttgcggaacgtcttggagtcagccgcacccctatcagggaagccatcagaaagctggagctggaaggtctggtgttaatggtgcccagaaaaggggcggaagtcgcaaagatttctgaaaagagcttaagagatgttttagaggtccgcagatccttagaggagcttgccattgaactggcctgtcagcgcatgacccaggagtcagtggaagagcttgaaaaaaagcaggaggaatttaagcaggctgttgaagacggcaatgccatggaaatcgcggagactgatgaggcgtatcatgacgtgatttataaaggcacctgcaatgacaggctggtgcagatgatcaataatttaagagagcagatgtaccgttaccgtttggaatacatcaaggatgaggataagcgccagatccttttgctggaacatgacaacatattaagggcggtcaaacagcggaaggtacaggaggctaaggaagccatgcgggagcatattgataatcaggagatcaccgtatcaaagaatatcaaggaacaggaatgagaaggagagggatcctatggcatttaaggagaaatatctggccggtgagatagaatttgaagccattgatgattttgttgaagaatggaataacagcactaccaccgaaacccttgcccggtttctcggccttaatgaagaggaagaggatgtgtggattgaggaaagcgatgaagccttaaaggagcttcttgacagtaaaaaataaacagagttggaaaaattattaaataaatataacctttcttgacaaggtgacaacgtgtcattataatgaatgacatattgtcaccttgatgtgtttccacggattcacatgaagttacagaaaggagaggtgaaaaaatgcctactgatcggttttatcatcttccgacagctaaaaaaatgtccattcgcgatgccgcggtggaggagtttactcgagtaccgtttgagaaggcatccatcaacaaaataatccaggccgcaggtatatcgagaggaagcttttatacttattttgaagataagcgtgatgttctgggatacatttttgaggaggctgctaaaagatttcagaatggctgggtgagctgtgctgaaagaaacggcggtgatttatggaagactgcggaagagtttttgcaatacagcatagccaatacacaggaaaatgtattgcagctggttaaaaatattgttgagggtgaaaagatgtttggtgtgactcaccgcttatgccgggaaaatactcaggcccagcaggaaatgcaggaggtgatgtaccgttctatcgatatgtctgatcttaaagatgaaagcattgagacctttggaaaggtagtaaccatgattttcttggaactggttcattgcatgggctggtactaccaccatccggaagatgaagaaaaaattaagaaactcttccaggaaaaattagaaattctgcaatatggaattcgtaaacaaccattacaatcttaatatggctaaataaggagttgactatgaccaagaaaaaagtattcatcattgcaggggcagttgtaattgtagcggctgtggcaggactgatccttccaagaatgctggaaggaaagaaggaagagcttgtggcggaggtcccgccggctgtaacagcagaaaaacctgagatcaggaccattgaattaagcaatgaactaatcggaacgattgagccggacagcattgtccatgtcactccccttggagccggggaggttacaagtgtaggcgttaagacaggagatgcggtatctgcaggccagcttctctgtgtcatcgacacaaagcaggtggaaagctcccggatcaccgcggaaaccgccagaatcacctatgaggacgccagaaagaatttagaccgccttgcggttctttacgcagccggcgatgtggctgaagcggattatcagtctctggttgataaaacggagatggcaagacttcaatacgagaatgccaagatcgcatataatatccagacagaaagcagccaggtgaccgctcccattgcagggcgggtggaaagctttagcgtcagcgttcatgatatggtttctcctcagaccactatttgcgttatttcaggtgaaggcggaaagtccctgaccttttatgtttcagagagaatcgtagggggattaaaggcaggagataccataagagtggaaaagaatgggaccgatcatgaggcgtccatcacggaagtgagcacaatgattgatcaggaaagcggcttgttcaaggtaaaggcttccattcccaacggggattccctggcaacaggaacttccgttaagctttacgtaaccgcccggcgggcggagaatgtcctgacagttccggtagacagcatttattatgagggcgggaacccgtatatttatacatatgcaaatggagttcttaagaaaaatgccgtgacagtagggctggcagacaatgagtacatagaagttcaaagcggcatcactgccgacgatcaggtagtgaccacatggaccagcgaattgtatgatggttccaaggtcacccttgcagacggaaatggaaaagaatccgagacaccacaagacacggcagaatcagaaggaaccgagacagaaacttccggtcctgcacagtaagggggcggtgaaatgggaattacaaaattcgttttaaagaggcccataaccaccgtcttagcggtattgtgcctgctggtcttcggtttgtcctctgttttatcttcgaaaatggagctgacaccggaaatgaactttccaatgctgctgatcagcagcgtttatgcgggagcgaaccccgaagatgtaaatgacctggttaccaggccggtggaagaggccgtaggtaccttgtccggcgttaagaatgtccagtccagctcccaggaaaatgtttctatcgtaatgctggagtatgagtatggtacggatatgaataaagcatattcggatctgaaaaagaagatggatatcgttgaactccccgacgacgtggaaactcccagcgttatggaattcaatatcaatgacatgccggtggtaactctggctgttagagatccatcccagaacaatctttataactttgtgaatgataagatcgtaccggaatttgagaaaatttcttccgttgccagcgtaaacatgagcggaggccagaagagctatgtgagcgtccggctgatccctgaaaagatgaaccagtatcatcttaatatgaattccatcagccaggccatcaaagcagctgactttacctatccggcaggaaataccggtgtgggaaagagagatttatccgtcagtacgggggtagaagttaagagcgttgaaagccttaaaaaggttcctgtggttgcaggcggtggaaagaccatttacatggaggacatagctgaaattacagaagcctctgaaaatcaggaagccatcggacggtataatggggaagacaccattaccttaaccattaataaacagcagaaaaacagtgcggtggatgtttccaagtccatgaccaggactgttgaaaccttaaaaagggaatatcctaacctggatatcatagtagttgacgataccagcgaccagatcacatctgcccttgacagcgttaagaataccatgatcatggctgtcgtcatttccatgatcattattttcctgttctttggagatatcaaggcatctctcattgtaggaagctccattcccgtatccattctggtgtctttgatcttaatggctgccatgggcttttccttaaacgttatcaccatgagcagtattgttctgggtgtaggtatgatggtggataattccattgttgttatggagagctgtttccggtcccaaaagggcaccgggttccgagaatatatgcaggcggctctggaaggcacgggaatcgtgctccagtccattctcggaggaacgattaccacctgcgtcgtgtttattcctctggcgcttttggaaggtcttactggccagctgtttaaacccttaggctatactatcgtattctgtatgctggcatctctgatttctgccattaccatagtcccgctgtgctacagcaggttccgtcctattgaaaaacagaattcccctatgggcggaattgtaaaagcaatgcagaacggctaccgcaaaatcgtaggcagactgcttaataagcgtgcgacagttatgatcgtgtcagttctgcttttgattgcgtcctttgtactggcaacaaggctgggctttgagttaatgccggaagtggaccaggggacgattaccgttactgctgagatgcgtccgggacttaaggtagaagaggctgataagattttaaagaagctggaaaccatcgttaccggcgaggaagatttaaaatcctatatggtcagctacggtggaagcggtttaagcttcagcggagctaagaatggaaccctgactgcttatttagagagtgacagaaagctgtccaccaatcaggtggtcactaagtggaaaaaggaaatgaaccagattcccgactgcaatgtcactgtggagtctacctccagcatgagcagtatgagcagcacacatgattttgaggtaatccttcaaagctcccagctggataaactgaaaagcgtttcaagtcagatggtggcagaactggtccagacccctcagctgatcaaagtccattcggacttagaaaatgcggcgcctgtcattaaggtccatgttgaccctataaaagcggcggccgaaggcgtggttcctaccaatgtaggcggtttgttaaacactatgctcagcggttcaaaggcagctaccatggatgtgtccggccaggaagttgatattaaagtggaatatccgaaggattcttatgatactcttgataaggtggagggaatcatgattccaaacagttccggcggctctgtggcccttacggatatcgctgatatcggttatgaagacagccctacttccattagcaggaagaacaagcaatatttagtaaccataacaggctcttttaccgatgtggtaaaaacgaataaagaaaaagaggcaacgaaaaaggatattgatgaaaagattgtaaacaaatatttagatgatattgttacaagggcaaagaacagtgaagatgaatccatgcaggaggagttttccaacctgtttagcgcgattgccacagctgtgtttctgatcttcatcgttatggctgcccagtttgaatctcccaaattctccctgatggtcatgacgaccattccattcagcttgatcgggtcctttgggttcctggcggctgcgggagttgccatcagcatgccgtccctccttggcttcctgatgctcattggtacggtggtaaactccggaatcctatatgtggatacggtgaatcaataccgggctaccatggataagcggactgccttgattgaagcaggagctaccagacttcgccccatccttatgacgacccttaccactgtggtatccatgattcctatggcaatggccatcggaagtaacggagagaccatgcagggccttgccctggtaaacgtaggcggtttgacagcttccacaatcctgtcgctgctcatgctcccggtatactattcccttatgagcggtaaaacagataagaccatattgccagattaagaggcggcagggagccggaccttcgggaaatccggttccctgctggaagaaagtggattttaagttattatcatgatatgataaaataataacaggaacacagcataaaaatcccagttgaggaggattaaggatgagaaaatggaaacagatcagtgcatgttgtcttgcggcagtgcttactgtcatgggaccggcggccacagcctgggccggcagcccggagtttgcaagaactcctgaagagtgggcaaagctcagagacaatgtgatggaatacgatgaactggctggcctgatccgtgaatataatgtgacggttcagaaaaaccagctggatattaatgataagaaaaaggatgacaggatcaccagtgatcagaatgcacagtattatcgggatgcggcagacgactacagaaacggtatcacaggggatgacccctatgccgatgcatccaatgcggcaggagccaaccgggcggaagcggcggctgattctaacgtggaggatttaaaggtataccagcttacctatgaccaggaggaagccaatttagtggcgtcggctcagtcttccatgatcacttattttcaacagaattatgagctggaaagcgcaaaaagcagcctggagcttttggaggctgtgtatcagtccacccttgtaaggcaaagcgcgggcatggcgacccaggcggatgtgctgggagccctggaaagcgttcagagcacccaggcgtctattgacaagctgacctcctctattgaagagaccaggcagaaactttgcgtcatgctgggctggaagtacaacgatatgcccgagatccgggaaattccggctgtgaacatggaacgcattgcggccatgaatccagacacagagaaggaagccgccttaagcagcaactataccttaaagatcaatcagagaaagctggaaaatgccgtgggcgatgtaacgaaacagaccttgaaccggacgattgccagcaacgaacagaatatcggctccgatgtgacaaaatgctaccgggctgttcttcaggcaaaggcagcttacgatcaggcaggagcagaacttgcactggaaagtaaaaatatggatacagcccagaggaaattcgacttgggctctttgagcaggctggattatataaagcagaaaaatgcttatgacacaaagaacatcgccataaagacagcagagcttactctgttccaggcgattcagaattatgataatgcagtaaacggactggcttcggcaggaggtttataagatatgagaaagaaaggttatttttctgcctgtatggcagtgacccttgctctatccgccgccttgccggtttacggggcagcaggccccggacagacggtaatttccattccggacgggatgacggaggaggcatggaacaaactccaggatcagaccatagaatttgatgagctttcagaccgggtgaggtattttaaccctgatttgcagaacattgttgattccgcaggaaatgagaagagcaaccagcagtatgtctatgacgagataaaaatatatgtccgggatcttaacgacaatgccaagtccctgaaagattcaggtgccacagatactgcggatggtatgacggaatacatgactttaaaaactacggcaaagttgctgggtgacggtgcggagactctgaacaaagtgatcaaacggattgattcaggggtccagaagaacgttgaccgttattccaagaccttctcttctgccgtaggtcagatcatgataggctataacagcgcccttgctaaccgggctatgctacagaagatgctggatgtcagcaaggcaggttatgaagctcagtccttaagctttcagcaggggatggccacggaagcagatgtgctggaagccaataaaggggtgctggcggcacaggcatcactggaacagcttgataacaccattgacggcctgaaacgttccttatgcctcatgaccggatattcggcagatgcagaggttcaaatcggaggggttcctcaattggatctttcccttatttcttccctgaacttagaggcagacacggctaaggcggtggggaataattacgatctgattgaaaagcgccgcggagcttccggccagaccaccaccggtataaaaaccaaggaagcaggtctttcagagggagagcagaatattacggttgccatgcagtcctattaccagggaatccttcaggcgaagtcggcttatgacgccgcctgtacctcttatgagaaagcggtcctggaaaagaataaggcggaccgttcctatcagcttggcatggtgagcaagctgggctatctccaggcccagatggcatttctacaggccgagggtacaaaggagagtgcttataacaccctgtatcaggcctatgatacctatcaatgggcagtaaacgggatcattacggattctggacagtaggctccggcttttttaaaagtaagtcggccagcttaaaacgaatatggatcttcggggtttcacggctgatcctcttataatcagattcatccatggagcttcttaaaatttccttggaagtatccggcacaactgcataggaagaatctgtgaaacaaagaggaggataaaggacgcaccaccagttgcgtccttttccttcgcctatttttacccggacggcctcataattgccgcaggggaataccatatcaccataggttttagtcggaaagtaacaattggtcagttccatatgtgcgggataatcgtatcccagttttttcatgtagtgttccgcttttttctccaggctgtccttatgggtgagaacatagccttttgtttcctcaagtgatgcattttctccaaggtcctcatatattgaattgagcagcatggtgcgcacttttaattttaaattctggtcttctgagctgtcgctgtttgccaatacgtgaaaacgcaggatttccggagcgatccgtgccgccagtgcttcatcactttgccttccgtctgataaggtaagcaaaaatgcaatcaggaaacaggtaatacataaaaatagatcacgtttctgtttcattggggttcctccttttttctggaatctatttgtaattgtaaccatatgtgctataatataaacactgtaaaattgagaaatttgtaaggagatcaaaatgggtaaaaaaactgcggttgtattatttggcggccagtcatcggaacacattgtatcctgtatgtcggtggtcaatgtgattaaccatattgatagagataagtatgatgttgctttgatcggaattacggaagaaggccgttggatcaagacggattctgtggaagatattgaaaagggcacatggaaaaacgggcatgtttctgctgtcatttcacctgatgccaccatgggcggtgtcatcttaatggatggggaaaagacagaggtgcttaaggctgatgtggtattcccggtgctgcatggattattgggcgaggatggaactgtccaggggcttttggagctggcgagaattccctatgtgggctgcggtgtactggcatccgctgtttccatggataaattatatacaaagatcattgtagatgacctgggagtcactcaggcagcttatgtgccggtgatgcgccatgacttatcggatatggaaacagttgtaggtaaggtggaggaaaaattctcttaccctgtattcgtaaagccctccaatgccgggtcttccaagggcgtgagccgggcaggagacaggaaggagcttatagaagctttggaggaagctgcaaaccatgaccgcaagatcctggtggaagagatgatcatgggccgggagatcgaatgcgctgtgtttggaggcgggagcgttcctgtggaagcctccggagtgggggagatccttgccgcagcagagttctatgattttgatgccaaatattacaacgctgattccagaacagttgcagatccggtactgcccgaaggagccgcggagcgtgtgagagaagccgccaaggccattttccaggcagtagacggctatggcctggcaagggtggattttttcgtgaaaaaggacggcacagtggtattcaatgagatcaataccatgccgggatttacagccatcagcatgtaccccatgctttgggaatcggccggagtgaataaggatgaactggttgatcgcctgatggagcatgcgatggaccgtttccggatatagtcgggcagaaaagaggaacgccttacggcatacctttatgcccaaaagatagggcagaaaagaggaacgccttacggcatacctttatgcccaaaagacagggcagaaaagaggaaatttgatggcagacagaaattcgcccataggggtatttgattccggcgtaggcgggcttacggttgcccgtgagatcatgcggcagatgccggatgaaaggattgtatattttggagatacggcaagagtgccctatggcagcaaatcctgcagcacggtgatccgttttaccagacagatcatccgctttttaatgacccaggatgtgaaggcgatagtgatcgcctgcaataccgccactgcctgtgcccttgaggcagtggaaaaggaagtggatattcccattgtgggcgtgatccatgcgggggcaagaaccgccgtagaatctacgaaaaacgggaagatcggtatcattgggacggaagggaccatacgaagcggggtttacaccagagtgatgcaggaaatgaaagaagatattgaagtgactggaaaaccatgccccttttggttcctttggtggaagaagggcttttgcatgattccgtcacggatgagatcgcttccagatatttaagcgaattaaaaggaaaatatattgatacactggtacttggctgtactcattatcccttactgcgttccactgtgggaaggcttatgggaccggaagtgaccttggtaaaccctgcctatgaaactgctttggaattaaaacagattttggaagaaaaaggccttttatgcggacaggaaagcaatgttccggaaaaataccgattctatgtcagcgacctggcggagaagttcaccagttttgctacctctatcctcccgggacaggtaaaagagacagagcaaataaacattgaggagtactaaaggagtttataatatgacaagagatgttctgatcagcatcagcgggatgcagattgcagaggatgacaacaatacagttgaaatgataactgccggtgattatttcctgaaaaacggcaatcactatatcctctatgatgagatccaggaagacacaggaggagtaaccaagaacaccattaaaatccgccggtcaggactggatatcattaaacgcggctgtgccagcgtccatatgacatttgaaaaagataaaaaaaatatgtcctgctatgccactccctttggagaacttatgatcgggataagcacaaaggacattcagatccatgaagctgaggacagcttaaaggtgcgggtagcctattctcttgatatcaattaccagcatgtgtcggaatgcaatattgttttggatatccattccaaagccacggcggacatccgtcttttgaattaaaaaaggacatatgccatgtgaacttatctctgtcaagtgacagggggcagttcacatttgcctatgcctttttcaattactggataaagcagtctttcagaagggggatggctccatatttaccaagaagataatccttggaaaagctggcgtcagaccggacctttatgtccgctaaggtgtatagcctggattcctgatattcattcatatcaacaaaggccacttcgtcacggcggaactgttgattgtttaatatggagatatcataagtagtgaaaatcagctgtatgtttttgattttttcctgctgaagaaagtctataaaaaattttgtaacagccggatggaattcgtttgatatgttatcaataatcagaataccaccctttttggacaaatagtaaatctgtataaataattgaagggatttcattgtaccaagggagaccttggtataatccatgtactgggtctcatatttaccggtgacccgggatttcacccggtagcccagctttgggattccttatcaataataagttcctctgccgggattcccagctttcttagctgttccaatccataattgagggcttcggggtgttcaagggctttgtaggctctgccatccatgatcagatttccagcaagccgaaatggttccagaaaatcgcagtaataattgatctgtttcaaaaagaaggtttcaaagggctccataatgactgagatttcgggaatatccaggcatgataaaacggaacaaaataaccggtcccggtgagggcggattcctgccttctggcgtaaggctttttcgtactggcgcccaatggacagattatcctcagtccgtgtaaataccacatggttatctactgtcagaaattcggtgagaattttttcctttaagacggaaaagccgtattcataaacccgctgcccgctgataaaggagagctccatttccgttggaagggaattggtttcctccatatgaaacggaagaattctgtccaaagcagtgacctgcaggattgacataaaatgctttctgggaatgtctttcagtgaaaaaagctgccagaaaataaaagaatgaaagctggcaaaagcgagaaaaagattggttttcccgctggcgtttgcaccatatacggccagggtcttaatcagttttttgttgccggccattaccatatggcttgggtgctctttataattgaccgccttcatatcaataaaagtttcatccagaaaggaacggaaattcttaaaacgaaaagaaattatcatagcatactatcctccttttcggaattataccgtaaaaatatgtaaaaataaacaaaaatgcaaaaaaattacttaccaggtaataatttcatcaagaagctgctgctgttcctgactggaacgggtaagatagattcttgtggtctcaatgctttcgtgtcccattaaatcagctaaaagagaaatatcattaaaacaggccaaaaagttctttgcaaaacgatggcggaatgaatggggataaaccgtatcaggatcgatcccatagcgccttgccaaatgctttagctgaaaattaatgcctctgggagtaatcagacgtccgtctttatttaaaaataggaagccgcttcgcttgtcctgtccgtggcaccattctaaggcttcctggcatagagaatctgggaaatagatgcggcggacctttcctcctttggaatacaggtccagataccccaggtttaaatgctccaccttgatttggatcagctcactgactctggcgccggtagttgccagaaagcggacgataaaataccagaagtagtttttctcttctttcaatttttcttttaaaagctcatagtcttcattggaaataacggagtccatgaaagtcttttgctggacttttacggaaggcagatggtaagaggcaatgaaaatgtattcctcaccattggtttctgcagaaaacgcgaatagtgattcatggcatggatccgttgattgacggttgccgggcggtaatgggtgattaagtaggtcttataacgctggaggttttccggcgtaatttccttattcatgctgaaaaaaaggcggacacttccctcataggctgtaatcgtattgtttgacaaattcttttttttcagaaatttcttataatcattgagtaattcttcattttccataattttctaccaattcacaatctgattgacgatctgtttttgttccgtgctgctccggtgaagatagatccttgtggtttcaatgctttcatgtcctaaaatatcggaaagcatggaaatatctccgcatatttcaatgaaattctttgcaaaacgatggcggaaggaatgaggataaaccacagtgggatccaaatcatagaggacagtaaatttttttaactgccccggattccggcaggtgtgataggatccccgtagcggtttaaaaacacgtatccgcttaccctgtcaatttgatgaagccatttcagcgcctccacccggaggctttttggtatgtaaattcttcttattttattatcttttgagtaaatatccatgtaaccgcattttacgtgctccaccttgatctggaccagttcactgacccggacgcctgtggccgccataaagcgtatgacaaaataatacagcatgtttccggaacgtatcagacatttttttaaatattcgtaatcagcctggctgattacgttttccaggaatgttttttgctggacgcgtatcatcagtactttagcagaggacagctctaaggactccatgtaacaattcagagctctgattcttaagtttactgtctgaggcttgtaatgctccataaggtagcatttataaagcatgagattatcatggctgatcacatgatataagccaagaaattgttttactgcgaataaatacacgtgaatggtattgggagacatgttattgaattccaggtaatcatggaaatcatcaagactttgctccacgggacttttgctttctgcttctgaaccaattacagtgctctctgttatcatgtcattttctctcctcgtataatgatgcaaaaacagtttaacacaagtatataagcaatgtgtaaataaatcaagaaattttcgaaaaattagtaaaaaatattgattaaatgcatataaaatgcccgttgctttcgataatttccaatattagaagtataattacctcgtaatgcaattaggaatttcgaaaaaatatttcaaaaagaaaaaggagagtgcattaattatgagaaagcagacgaaattagttgctgtattatccacagcagcattgcttgcattaggtgcttccatgtcttctttcgcagcaacaggctggcaggaagaaaacggtacatgggtgtactatgacaagagcggcgacttagagacagagaagtggcagaaatcaggagacaactggttctacttaaacgaagacggcgaaatggctaccgatgttgttgttgaatacaatgacaattactactatgtagatgagaacggcgccatggcagccaataagtgggtttccgttgagaatgaagattatgacggcggcgacgatgatgatgaagaacccatgaaccactggtattatttcggatctaacggaaaagcttataagagctctaccaccggaaactctgcttctttcaagacgatcaacggaaagaaatatatttttgatgatgaaggcaaaatgctgtacggctggatcgacgatagcggagatcgggtaactggtgatgataaatggcgtgatggcatttattattgcggtgatgaaaacgatggagcacagagagtcggtcagtgggagtatctggatatcgtagataacagctatgacagtgccgttgacgttggtgtttccagcgataatttatttgatgatgaagatcagacacgttacttctatttcaagaccaatggtaagaagatgactgacgaaaagggcaagaccattaacggcaggaagtacagcttcgattcagacggccgtatgaatgctgagtgggttaactggtcagctactcctaacgaggcaacagacagcactgctactaccagccagggaaatgctgtatataccagaggattcagatattatggaagtcctgaagatggcgccagagtaacaaaaggctggttccaggttgtgcctgattcttatttaagcagggatgactatgatgatgatgagaataactggtactattctgataaggatggtaaattagttgcatctgaaatcaagaccattaatggcaaaaagtatgcatttgatgcctacggcgtaatgaaggatggtctggttgccattaagtttgttggcaacagcacaactgacattgcagacgttgcaggtgatgatgacttagctgcttacaactttgatactgaggatgaattcaaggaaaatgtatctggtctgtataaggatgcagaatacaaactctactattttggtggcggcgatgacggtgctatgaagaccggcaagcagaatgttaccattgacggagattctttccagttcttattcaataagtccggaagctcaaagggacagggtaaatttggcgtagatgatgacaagtattatcttggaggtatgctgttaaaggctgataaggacgacaagtattctgtagttaaggctacgacagttgatggagaatatacagaaattaagcttctgacaacagagcggttcttagatgatgaaggcgtagagtttgagaaaataaacaaaaccggatatgacgagtattatgagattaagtccgcagacaagacagaaggtaataaaactgtagtatatagactggttaatacctctggtaatgttcagaagagcaagagcaaagcaaaagacggcgatgatcgttgctacaaagttgaaagcaacaaaacaatcacagctgtatttgtagaagattaattcattattaaatgaaataatttcaggtgcttttctggggccgttgtaccattgttgagaaatcaacctggggcaacggccctgtttttataaagaattcaatgcaaaaaatgccgcttcctgacgaaactactgcaggaagcggcattttttgattttcataaactcagctcatatatgatttcagcatccacagaagcttctggtattcagccagataaccgttaaattgatcagcggtagctccatcatcatcgtcctcggccagcttaacaatttcttttgtatcccggatccagtattccacatccgagatcaggcttttaatggtttcatctgatgaaataggaacgtcctccagctctttcacggaagagagagccagtgcctcctttaggctggctacaggagaaccgcccaaggccagaagccgctctgccacgtcatccatgacctgtgcagtctggtcatacagctcttccagctttgcatggagagtgaagaagctgcggcctttcacataccagtgcaggttatgaagcttgatatacatgacctgctggttagccagatactcattaagtttttcaaataaattcttgctcattatattcctccttttcttaacctttcattatgttttcatagttagaagcaacggccttccaatcaattacattgaaaaatgccttgatatagtcggctctaagattcttatatttcaggtagtaggcgtgttcccaaacatcaatgccaagaataggaacaaaacctttgccttccatgagagggttgtcctgattggcactggcggaaagcaccagactgccatcacggtttgctgacagccagccccagcctgatccaaactggccggcagccaggccgcttaactgattctgaaagtcaggaaagcttccaaaagctttttccagggcatctttaaggaaaccgtcaggttcgccgccgccgtcaggactcatggtggaaaaatagaggttatgattatagaaacctccgccattgttgcgtatcgccttcctgagcgcttcgtcggagatgctgtccagagaagagagcagggaggtgatttctttatctgcaacaccggccttctcagcagcgtcatttaagtttttggtgtaagctgcatgatgcttggaataatgagtctccattgtgagagcatcgatatggggttctaaagcgtcatatgcgtaagataattgtatttgattaaacatagtaattctcctttcattgctaaatttatattgaattggttatcttttaatgaggttagtattgactaactaccttgtggtttaattgtatatcatatgttcggttttgtcaattggttttttaaaatttaattgaaaacaactatgataatggtattcgccggaaatatgcattaaagtttagattaatattggatttgagataaattaaaagaaaactgtaatctctttttgatgacaatagaacagcatagatgaaataattaaaacagaaatgaatgaggcatgttcctaagaactggaaaaaggacagggtttcttcctaatataatatgaggaatcggggccggagcttttcgtgggttacttcccggccatgaaccggccggacaaaatatgacggccaaaactgtgctttatcaacaaaaaatgccggaatgcgattaaaatcgcgctccggcattctgcacagatctttttataatacagatcactttctaaaaaacgggtatccatgtatcagtgaatacagaaatctcactttccgatcttcttaaacctgtccaagaatgtcttctttttcggcgccggaggaaccgctttgccccgaaggctcttgatctcggttatgtagataccgcttaccacaaccttagcttctgttttaaccggaagcacctcgaacaccttggcgtcagcgatcagtgtcataacctttgggccaacctttgcctttacaatgggcagttttgtgcggcgcatatactttggggtttgttcatacacgatcttaggaagccctgcatcctttagcttcatcttctttttatcgatcaccagcatggacacggtctgtgccgcagcttccaatgcctgctgctgttccacctgacgcttttccagctttcttccaagaaaataaaggactgccagagccacggctgcgatgaaaagaatcactaataatacgtttaaaaatgtgctcaccgggaatacctccaatagttcattttgtaaattgggcctatctgcaatagtataacacgttttcttggaaaatacaagtaaaaaatgcttgacaccttgacaacgtcgtgatattatggaatgtgcactattgtggatttgtgtgccttaaaggtacatttatgcccaaaaacagaaatgattagaaagaaaacaggggtgaaacgtcaatggagaaaagcagaatgcgtccggtcccagccggtaagagcctgagaatgagcttctcaagacaaaaagaagtgcttgagatgccaaacctgattgagattcaaaagaattcctatcagtggttccttgatgaaggattaaaggaagtctttgaagacatctctccgattgcagactttgcgggacacttaagtcttgagtttgtcaactttacattatgtaaggacgatatcaagtacacaatagaagaatgcaaggaaagagatgcaacctatgcggctcctttaaaggtaaaggtaaggctttgcaataaagataaagatgaaattaatgaacatgagatcttcatgggtgatcttccgcttatgacagataccggttcctttgtgattaacggtgccgagcgagttattgtaagccagttggtacgttccccaggtatatattatggtatcgaacatgacaaggtaggaaaagagctttatgcctgtacggtaattccaaacagaggtgcatggctggagtatgaaacagactccaatgacattttctacgtgcgcgtggacagaaccagaaaggttccggtaaccgtgctgatccgtgccctgggctttggcactaacgcagagattattgaactgttcggcgaggaaccgaaattattagccagctttggtaaggatacgtccgataattaccaggatggcttattggagttatataaaaagatccgcccaggtgaaccgttatctgttgatagtgctgaaagtttgttaaatagtatgttttttgaccccagaagatacgatcttgcaaaggtcggaagatataaattcaataaaaagcttcatttcaaaaaccgtatcacaggccatgttcttgctgaggatgtggtggataccacgaccggcgaaatcctggcagaggctggaactacagtagacaagcagcttgcgaccgatattcagaatgcggctgttccttttgtgtggctggaaggagtggagcgcaagcagaaggtcctttccaacttaatggtagatttaacttcttttgtaaactttgatcccaaggatgcaggtattacagaattagtattctatcctgcccttgaaaaaatcctggcagaagctggaagcgaggatgaggaggctcttaagaatgcccttcacagaaatataaacgagctgattccaaagcatatcacaaaggaagatatcctggcatccatcaattacaacatgcatctggaagaagaggtgggtacggctgatgatatcgaccatttaggaaaccgtagaatccgggccgtaggcgagcttttacagaaccagtaccgcatcggtctttccagaatggaaagagtggtccgggagcgtatgacaacacaggatatggatggcattacgccccagtccctgatcaatatcaaacctgtcacagcggctgtgaaagagttcttcggaagctcccagctgtcacagtttatggatcagaacaaccctctggcagagctgacccataagagacgtctgtccgcattgggacctggcggtctttccagagaccgtgccggatttgaggtccgggacgttcactatacccattatggccgcatgtgccccattgagacgccggaaggtcctaacatcggtctgatcaactctcttgctacctatgcgagagtaaaccagtatggatttgtagaagctccttaccgtgtggtggataagaccaatgcccagaacccggtggtcactgatgaggttatttacctgacagctgacgaagaagataacttcgtggttgcccaggcaaatgagcctttggatgaggccggtcactttgttcataagaatatttccggacgtttccgtgaagaaacttccgagttccagaggaaaaacattgacctcatggacgtttctcctaagatggtattttccgttgcaactgccatgatccccttccttgagaacgacgatgcaaaccgtgccctcatgggatccaacatgcagcgtcaggccgtgcccctgttaacaacagagactcctgtagtaggaaccggcatggaatccaaggcggcggtagactccggtgtttgcgttgttgccagaaatgccggtgttgtggagcgttccgcttccaatgaaattattatcaagagagattctgacggcggaaaggatatttaccgcctgaccaaatttaagagaagcaaccagtcaaactgctataaccagaagccaatcgtatataagaacagccatgtggaaaagggagaagtcattgcagacggcccgtccactcagaacggtgagatcgctcttggcaagaaccccctgatcgggttcatgacctgggaaggttacaattacgaggatgcggttctcttaagcgagaagctggttcaggaggatgtttatacctctgtccatatcgaagaatatgaggcggaagcccgtgataccaaattaggaccggaagagatcaccagagatgttccgggagtgggcgaggatgccttaaaggatcttgacgaaagaggaatcataagaatcggtgcagaagtccgtgccggtgatatcctggttggtaaggtcactcctaagggagagacagaactgactgcagaggaacggctgctgcgcgcaatcttcggcgaaaaagcaagagaagtccgtgatacctccttaaaggttcctcacggtgcttacggaattattgtggatgcaaaagtatttacaagagaaaacggcgatgagctttcaccaggcgtaaaccagactgtccgcatttacattgcccagaagagaaaaatctctgtaggtgataagatggccggccgtcacggaaacaagggtgttgtttcccgggtgcttccggtagaagatatgccgttccttccaaatggccgccctcttgacatcgtgttgaaccccttgggcgtgccgtcccgtatgaacatcgggcaggtgcttgagatccatttaagcctggcagcaagagctcttggatttaacgtatcaactcctgtatttgacggagcaaacgagattgatattatggataccctggatgtagccaacgactacgtaaatacggagtgggaggatttccaggaaaaatatagtgaaacattaaagcctgaggtcattcagtatctgggcgatcacctggaacacaaggaattgtggaagggcgttcccattaaccgtgacggtaaggtccgtcttcgtgacggccgtaccggcgagttttttgacagcccggttaccatcggccacatgcactatctgaagctgcatcatctggttgatgataagatccatgcccgttccacaggaccatactctctggttacccagcagcctctcggaggtaaagcccagttcggcggccagcgtttcggagagatggaggtttgggctctggaggcctatggtgcttcctacacactgcaggagatcatgaccgtgaaatccgatgatgtggtagggcgtgtaaaaacttacgaggccatcataaagggcgataatattcctgagccgggaattccggaatccttcaaggtattgttaaaagagcttcagtctctggcgcttgatgtaagagtgctgcgtgatgacaatacggaggttcagatcgcggaaagtaccgattacgaagaaacagatttaagatccatcatcgagggcgacaggcattaccgggaagaagaatcctttagtgacttaggttatcagaagcaggaatttaaggatgatgaactggtaaccgtcgatgaagatgaggaggtagacgttgtcgaagattcttttgaggatttcgatgacgtggaatttgaggattcagacgaagaataatggaagggagaaccgcgcatgcctgaaaataatgaaacttaccacccaatgacatttgatgccattaagatcggtttggcatctccggagaagatcctggaatggtcccatggtgaagtgaaaaagccggagactatcaactacaggaccttaaagccggaaaaagacggtctgttctgcgaacggatctttggaccgagcaaggactgggaatgccactgtggtaaatataagaagatccggtacaaaggcgttatctgtgaccggtgcggcgttgaagtaacgaaggccagtgtccgcagggaacgtatgggccatatccagctggccgctcctgtttctcatatctggtattttaaagggattcccagccgtatgggtctgatcctggacatttctccaaggaccctggaaaaggtgctgtatttcgcatcttatgtggtgctggaagccggtaatacgggactgcagtataagcaggtcttatcagaaaaggaataccgggaagaaatagaaaaatacggctacggcaccttccgtgtgggaatgggtgcggaagccattctggagcttttgcagtccattgatcttgaaaaggactctgaggagttaaagaaggggttaaaggaagccacaggccagaaacgtgccaggatcatcaagagactggaagtggtagaggcattccgtaattccggcaacttaccggagtggatgatcatgacggttgttccggtaattcctccggatatccgtcctatggtacagcttgacggcggccgctttgccacctcagacttaaatgatctatacagaagaattataaaccgtaacaatcgtcttgcccgtctgttggagctgggcgctccggacatcattgtccgcaacgaaaagcgtatgcttcaggaagcggtggatgccctcattgacaacggcagacgtggaaggccggtaaccggacctggaaaccgtgctttaaagtccctttccgatatgttaaagggaaaacagggacgtttccgccagaaccttttaggtaagcgtgtggattattccggacgttccgttatcgtagtaggaccggagcttaagatctaccagtgcggtcttccaaaggaaatggctattgagctgtttaaaccttttgttatgaaggagctggtttccaacggaaccgctcataatataaagaatgcaaaaaagatggtagagcgtcttcagacagaggtatgggatgtgctggaagatgttattaaagagcatccggttatgttaaaccgtgcgcctacccttcacagacttggtatccaggcatttgaaccgatcctggtagaaggtaaagccattaagcttcacccattggtttgtactgcgttcaacgccgactttgacggagaccagatggcggttcatctgccgctttccgtggaagcccaggcagaatgccgtttccttctcttatcaccaaacaacttattaaagccttctgacggcggtcctgtggcagttccttcccaggatatggttttgggaatttattacctgacccaggaaagaccgggggccaagggtgaaggaatggtatttaagagcgtgaatgaagccattctcgcttatgagaaccaggcagttacccttcattccagaattaaagccagggtgagcaagaggatgcctgatggaaccgtaaagacaggagccgtggaatcaactgtaggccgtttcattttcaatgagatcgttcctcaggacctgggatttgttgacagatccgttccaggcaacgagcttttaatggaagttgacttccatgttggaaagaagcagttaaagcagattcttgaaaaggtcatcaatgtccatggcgcagttcagactgcagagaccttggatgatatcaaggccatcggttataagtactctacaagagcggctatgaccgtatccatctccgacatgaccgtaccggaaagcaagccgaagctgatctctgacgctcaggcgacggttgaccagattgcaaagaacttccgccgcggtcttattacggaggaagagcgttataaagaagtaattgacacatggaaagcgaccgacgaccagctgacccatgatctgttgacaggacttgataaatacaacaacatctatatgatggctgattccggagcccgtggttctgataagcagatcaagcagctggcaggtatgcgtggacttatggctgatactaccggtcataccattgagcttcctatcaagtccaatttccgtgaaggtcttgacgttttggagtactttatctccgctcatggagcccgtaaaggactttctgatacagctttgcgtactgctgactccggttatttaaccagacgtctggtagacgtttcccaggatcttattatccgtgagatcgactgctgcgaaggtaaggatacgccgtttatggagatcaaggcctttacagacggccaggaaaccattgaaagcctggaggaacgtattacaggccgtttcattgcagaaaccattactgatccggatacaggggaagttattgtaaaggcaaatcacatgtgtacgccaaagcgagctgctgcggttatgaatgtgttaaagaagcttggacgtgattccataaagatccgtaccgttttaacctgtaaatcccatctgggcgtgtgtgcaaaatgttacggagcgaacatggctacaggacagccggttcaggtaggcgaagcagtcggtatcatcgctgcccagtccatcggtgagcctggaacccagcttaccatgcgtaccttccacaccggcggtgttgccggcggcgatatcacacagggtcttccccgtgttgaggaactttttgaagcacgtaagccaaagggtcttgcgatcatcgcagaattcggcggcgtggtgaccattaaggacaccaagaaaaagcgggagatcattgtgaccgagaatgagaccggcaattccaagacctacctgattccttacggatccaggatcaaggttcaggatggccaggtgcttgaagccggcgatgagctgaccgaaggtagtgtgaaccctcacgacatcttaaagatcaaaggcgtccgcgctgtccaggattatatgatccaggaagtacagcgtgtataccgtttacagggtgttgaaatcaatgataaacacgttgagatgatcgtaagacagatgcttaagaagattaagatcgaggaaagcggagacagtgatgtgcttccgggaacctccatggatgttctggattacaatgatttaaacgactccctttttgcggaaggaaagaacccggcagaaggaaagcaggttatgcttggtatcacaaaagcatctctggctactgattccttcttatccgcagcttccttccaggagaccacaaaggttctgactgaagctgccatcaacggcaaggtggaccacttgatcggtcttaaagagaacgtaatcattggtaagccgattccggccggtaccggcatgaagcgttaccgcaccatcggattgaatacagattccgctttcgatgataaggatgagatcaccctgtcagaggatgatgaagagattctgctgacagacgatggctttgatgaggcggaagaggttttggatattgacgagaacgagacagcagaataagatgtaagatagcccttggcaggatcagactgccaggggcgtttttattttacaggaaagttctctgaacacccttgtaaaataaaaacactcctctgtggatgcgcactgcggcgtaagcggaagatatcccagtgggaccgccgcaggcgcaggagtttgcaaagcaggctctttattttggcaatattttgtggtatttgcacaagaaaacaaagtttttctttggaacctcatggtataattgtgaaaaagaggaggtaaagagaatgagaagttttgaacagaaagtgtttccataccttttgctggcgccgactctggtgattttcgggctgtttctgttttttcccgctctcaatggattgtggatttccctgaccaaatgggatggggtaaatcctcagaaatttgtagggattcaaaactatgttaaacttttatcagatagtagtttctggggatcttttttccggaccatattttttaccgcagtttccgttccccttgtctatgtgtcatccctggggctggctgtgcttttgactggaaatataaagggaagtgatttttttcgggcagtgttttactggcctaccatgatttccagtattatcgtaggattaacctggcgatttcttctgggagaggattttggggtcatcaattatctgctgacttatggtggaagggctccggtaaagtggctgacggatcagaacaacgccatggggtggtgatctttgtcacggcctggagcatgtccggctattacatggtcatgtttgtttccgggattaaatccatctctgagacttattatgaagcctccagaatcgatggggcggggctgtggcatcagttccgctatattacgcttcctcttctaaagcctaccagtctgctggtcattgttctctccacggtcaccatcattaagacctatcctctggtatatgccctgacacagggcggcccggcaggggccacaaaattcatggttcagaccattcaggagacaggctttgagaagaaccagatgggttatgccagcgcaatgaccatgatcctgtttctcctgttagccatgtttactgtcttacaatttaaggtcaataaggggggagaacaggatgcggactgatatgaagaaaagactttcagaagggatcacatgggtgcttttactggttctcaccttcctgtttctcatgcccgttgtctgggtcatctgctcttcctttaaaagtacaggagaattgttttcctggccgcccagcttatttggcaggagcccttcccttaataattaccggagagctttggaggaaggccgtttcggggtttattttttaaatacagtgtttaccagtctggttgccacatgcctgaccattgtggtcaatgtgatgtccggctatgcctttgccaagtatcattttaagggagaaaaactgcttttcggcattgtgctggcaaccttgatggtgcccttagaagtcatcatgatcccgatttttaaggtgatcgtggctgtgaacctttataacagcttatgggggctgatcattcctgcagtggcgtcgcccacggcagtgtttcttgtaaggcagtattatgtggggatccctgatgcctatatggaagctgccaggatcgacggtgcttctgagctgaatattttaatgagggtcatgctgcctcttgcaaagccggtcatttccgtgctatgtattttctcctttatgtggagatggaatgattatctctggcccaaactggtgatcaacagcaaggaacgttacaccattcagctggctctggcaaattattcaggggaatattccgtggattggaacagtctgcttgccatgtcagtggtatccatgattccggtcattattgtatttattacgttgcagaaatatatcatcggcggtatgacggccggcggagtaaaagaataaatggagaggaagtaaagacatgaaatatctggaatatccactgtttgcggaagggtttgtaaaccgttttttaattaccggtgtatacacccaggtccggcagtttacgaaaaccaccttaagcggccgggtaaacgaatggttaaagaaggggtttgccattcacgaaaatccatgcagaaaagaatttgtggcaaagagaaaggaagagctgccgccatgtccggactttagcggaatcaaccatggggatgctgtcaccgtatttgatcagacaagtcccatgaagctgtattttccatttggcaataccggagtggatgcttccgggttttattatcagcctacttatctgcggatgtatggttatacagagctttgggcagaaaaagaggaatctgtggtctttgaactggagacgtgcggaggcctgactttgtgggtcaatgaccggctggttacggattttaccccatttacacgaaatctggtaaagaagactgtagtgtccgtaccgcttttgcaggggcaaaataaggtggtcgtctgcctggatgatctggctgaaagggatacggattattacttccgcatgaagcggctgggagatggggacttaaagattatgcttcctgtcagcgatgagatcgaggaaagggtgctcgccgggttggagcggatgttggaggccatgagctttgacaaggaagcctatatcagcgagtccctgaaaatgaacctgaccaacccctttgattctcctctggagcttgatgtgatcataactccaggcgaatttattgagaagatgcaggaagcctggaagatgataacaacaaagcattactccatggagccgggtcagaagggcctttatttattggagacggatgagctgccgccgggatattattattttacggtatcccttacctatatggggatctctgtgaagcggaagattggaaaccagctggtgagaaaggagtttctggcatatcacggctccgatggaaaggccagaaaacgtcttgccctggaaaccataatccggtttgctcccgaaaatacctataaggcggctgcattgttccaggctgaaagagaatatcaaagggcggaagacatcctgcttgaggaactggaaggagtcagaagcaggaaagactgttctgatttccattttatcatcatgctttacatctacggtgttttccgtgaccggatatcggacaccttaaaaacagccctggaagacgccatggtccattacaggtactggatcgatgagccgggggatgatgtgatgtggtttttcagtgaaaatcacgccctcctgtttcactgctgccagtatctggccggttcctacttaccggaccgcatctttaccaacagcggccggaccggggcccaagcaaaagaacggggggaggaactgcttcatcagtggtttgatgaattcttccgggagttcataacagaatggaactccaatgcctacattcccgttgatgtactgggaatcggtaccctttataatctgacggataaggaaagctctcttcataaaaaggcgaaaaaagctcttgatatgatcttcttctctcttgccataaatgcccataagggagccgtcatgaccagctttgggcgaacctatgagaaagaaatgaaagggaattataatgcaggaaccacctctcttttgtatattgcatacaatgcgggatatttaaacagagcctgtattggttacatatcattggttctgggggattatgaagctccaaaagagtacaggcactatggggtgatagaaaaaggccgggagatgatatttgaaaatacccagggatttgaaggccatgtaaatctttatctgtataaggacagctgcgggcttttgtccacggctgtggggtttaagcctttcaaaaaggggtatcaggaacatatcatgcaggcaacgatcgacggggtagcccaggctttcatcaatcatccgggagaatccttttcttacggaagcggaaggcctaatttctgggcaggcaacggggtgcttcctttaggagtccagtatggggacacgggaatattaagataccatattggggaggaggaaagaattgattacacccatgcttatatccccatcagtgcattttcccgctataagggagaaggaggcgtgcttgtgctggaaaaggacggggcttatctggcggtgaaagctctggggggactgatcatgcaggaagaaggccccaaccggttccgcgagttcatcagcatgggcagggataatgtatgggtagtgagagttggcagcctggaggaatacggaaacctggataacgtctttcacgccttccagaagattgagatcactttggaagacgagaagaccacggtatccgatgacagaggagatatctatctggttgatgaagaattcctcttaagggtaaatggaaaaacggtatatgactatcccctggcagtggaaggaaaaataacattaagggagaaaataagacgtggttgacaaaagggtgattgatgaaaagttaaatcttgtatcccaaaagatgatggtacttaagaataatgggatgaaggagaaatatcccatcagcctcattgatatcaattgctgggagtggcctcagggagtgggactttttgggctttataaatattatgaagtcaccggaaaggaggagatactggattttctggtcaaatggtatgacaagaggctggaagaggggattctggaacggaatgtgaataccacctcccccatggtgacccttacttatctttatgagagaacggggaaagacaagtacctggctttcattcaggactgggcggactggatcatgaaggataaaaagctgatccggacaggtgacggctgctttcagcacatgatcacaggtgatcccaatgatgatgagatactcattgataccctgtttatggcggtactgtttttagcccgggccggtaagcttttaaaccgccgggactatatggaagaggccggttatcagatcttaaaccacataaaatatcttctcaataagaaagaaggacttttttaccatggctttaattttaagagaagagataattacggaggcattttatggggaagaggaaactgctggtataccattgttatcatggagcttatggatgagatggagcttgacggagggctgaagcgttatttcctcaatgtctatgaaaaccaggtcatggcgctgaagcagtacgcggatccggataaggggctgtggcatactgtcattaacagtccgtcctcttacattgaattatctgcaagcgctgcctttctttatggcatcatgaagggtgtccggctggggattttaaacggggaggagtttggagcactgattgagaaagcaatggaaagccttatggattatatagaagcggatgggaccgtatcaaatgtatcctatggcactcccattggaatggatgaagatttttataaaacgattccatgctgccccatgacctatgggcaggctctaatgatactggcacttcaggaggcgcttcagccgtattggaaatagaagcttcatatgccttagaaaggattggttgcggaaatgaaagaacgggtattctttgaagaatttgaatcattgtactattttcatggaagttccgaaaactgggccatgcagggcttccattttcacaaccagtatgaaatcatcctcttccttacggacggggcattgatggaaatcggaaaccgtacttatcacgtaaatgcaggggacttgttttttattaacaacaaggagtatcacaggaccagcggtgcggaaggaaaggcccacaaccgctatgtcctcatgtttgagcctgagcttcttgtgaacatggcagcggcttttcactacgatttctccgtgttttttgaaaaccggccggagcagtttattcacagactgcacctttcaggggaaaagcttgaaaaggtggaaaagctgtttggaaagatagaagggaatattaattccgaccataaaaacagcgcagaatcctcggttaagcttaagctctctattctggaagcaatcactgccattaatgaaatgtaccggttttttatagaagaggagaagaacaataagggcctggatgaaaagaggaagcaggaatttcaggatcccattttatacagggaaaggatcgagcagctgaaaaagtatatagcggcccatgtggaggagaggctggatctggatgaaatttcccggaagttttatatgaaccgctattatctgagtcattattttaaaaaggaaacaggctttactctcatgcagtatgtggcaaatcagaaaattatagcggcaaaagccctgttaaaggaaggaaactcggtgacggatgtggccttaaagctttcctataacagtgacagccattttattgcagtttttaaaaagctgaccggaattacgccgaaaaaatacgcgcagtccggtaagagaaaccatgcatgatttcctgtaccggatatacggccttttatacaggcaggctgatggaatgggaatgttaaatatgcccgtaaggcgggcgaaaaatgaaaaaggagaggttatttatgaaaaaagcggtatcattggtgttggcaggggcactggcactgggggcgctgacaggctgctctgcaggggggaaaaaggcggacaatgaagtgaaaacactggatgtggtatggttcagcgacggaaaggagggagaatccttcctggggctggcagatcagtacatgtcagagcatcccaacattaaaattgaactgattgaggttccctatgctgatctggagagcaaaataaaaaatatgctaaatggcaaagaagctcctgcactggccaggcttaccaatttaggaccgttccagaaccagctggtggacttaggacagtatgtgtccgataagaacacatttgtaaacagctttggcgaaggactgaaatttgtttttgatgataaggttctggcagctcccatggatgtgacggccaatggactgatttataacaagacggcttttgagaaggccggcgtaaaggttcctcagtcagaggatgagatctggacatgggatgaatggaagactgccatgaaaacagttatggaaaaaagtgactgcaaatacggtcttgtatatgacaagtcgcctcagcgttttaccacactgctttacgaggcagggggaagcctgttaaatacggacttaaatgcctccaattttaatacgccggagaccagaagggctgtaagcttttttaaagaacttcacgacgaagagatcattccgtcatcagtgtggcttggttctgagaatcccaacaatttattccggaccggtcaggttgccatgcatttttgcggaagctggatgatttcaaattacaaagaccagatcactgattttgaatggggggtgacttatcttccaaaggaagtgagacgttcctctgtgccgggaggaaaatatctggcagcattccagaatactggagtggaaaaagaggctgcccaattcattgagtggatttcaaaagcagaaaataacgctaaatattgtaaggaaaacagctacttatcccaggtaaagggaaatgaaagcctggattatgaatacggaaaagaattttttgatattttttcaaaagaactggctgctacggattcccagcctggagcagaatgggggtatcaggcatttaccggagctgtccaaaatgatttaagagataagctgattgaggtgctggcaggaaaactgactgctgaccagtatgcagaggatatggatggactgatcaccgaaacgctgaaggaactgaatgattaaatcatttaatagacccggaacaggaatgtccttaagaattcctgttccgggttttagcagtgaaatgatcttatttaaaaaaatccttgacagaaaaatacaatatgtatataataattaggcgtgcattaacgcgtcatgtttttgtgcgtaaattaagctgaagataacagcaaccacagacaatatcacaggaggtgaatggaatgccaacatttaaccagttagtaagaaagggtagacagacaagcgcaaagaaatccacagcaccggctctgcagaagggttacaactctttacagaagaaggcgactgatatttctgctccacagaaaagaggcgtttgtaccgcagttaagactgctacacctaaaaagcctaactcggctcttagaaagatcgccagagtacgtctttctaacggtatcgaagtaacaagttacatcccaggagaaggtcataaccttcaggagcatagcgttgttttaatccgcggcggaagagtaaaagacttgccaggtaccagatatcatatcgtaagaggtacactggataccgcaggcgtagccaacagaagacaggctcgttccaagtatggtgcaaagagaccgaaagagaaaaaataattagaaccacacatttgaatttctagtgccggactttagatattgaacctgtaggttgcagggttatatagatagaaaccgagcgcgaacgcaacttgaatgtttgtgagtacctaggatctaatgaatagccggttagtctgtaaaggctgacggccatattaaggagggaagtaacgtgccacgtaaaggacatactcaaaaaagagacgtattagtggatccgctttacaataacaaggttgttacaaagctgatcaacaatatcatgtatgatggtaaaaagggtgttgctcagaagatcgtatacggcgcatttacccgtgtagaagaaaagaccggtaaaccagccgttgaagtattcgaagaggcgatgaacaacatcatgcctgtacttgaagtaaaggcaaaacgtatcggcggagctacctatcaggtgccgatcgaagtaagaccggagagaagacagacattagccttaagatggattactctgttctctcgtaagagaggcgaaaagactcaggaagaaagacttgctaatgagatcatggatgctgccaataacactggtgctgctgtaaagaagaaagaagatatgcacaagatggctgaggcaaacaaggcattctctcattacagattctaataggaggaaaaagctttggctggaagagaatatccattggaaagaaccagaaatattggtattatggcccacatcgatgcaggtaaaactacattgaccgagcgtatcctctattatactggtgtaaactacaaaatcggtgatactcatgaaggtactgccaccatggactggatggcgcaggaacaggaaagaggtatcacaattacttcagctgccacaacctgccactggaccatgcatgaaaacaacaaagtgaagccaggcgctccggagcatcgtatcaacatcattgatactccaggacacgttgactttaccgtggaggttgagcgttccttacgtgtactggatggcgccgtaggcgtattctgtgcaaagggcggtgttgaaccacagtccgagaacgtatggcgtcaggctgacacttacaacgtaccccgtatggcattcatcaacaagatggatatcatgggtgcaaatttctatggcgctgttgagcagattaaaacccgtctgggcaagaatgcaatctgcattcagcttcccatcggtgcagaggatgagttcaagggactcattgatctgtttgaaatgaaggcttatatctacaacgacgataaaggcgatgatgttaccatcacagaagatcttggagacatgaaagatgacgccgagatttatcgtgcagaactggtagagaaaatcagcgaattagatgatgaattaatgatgaagttcctggaaggggaagaaccttctgtggaagaattaaagatagcattaagaacagcaacctgcgaatgcaaggccattcctgtatgctgcggaagcgcatacagaaacaagggcgtacagaagctcctggatgcgattcttgaatacatgccggctcctactgacattccttctatcaagggtgttgatatggaaggcaatgagatcgaaaggcattcttctgatgaagagccgttcgcagctctggcatttaagatcatgacagacccattcgttggaaaactggcattcttccgcgtgtactccggtgtcatgaattccggttcttacgtgctgaatgcaaccaaaggcaaaaaagagcgtgttggccgtatccttcagatgcatgccaataagagatctgagctggataaggtatattccggtgatattgctgcagccgttggttttaaaataacaacaacaggtgatacaatttgtgacgagcagcacccggtaattctggaatccatggaattcccggagccggttatcgatatcgctatcgagccaaagaccaaagctggtcagggcaagatgggcgaggctttagcaaagcttgcagaagaagatcctaccttccgtgcaaagaccaaccaggagactggacaggttatcatttccggtatgggagagcttcatttggagatcattgtagaccgtctgcttcgtgagttcaacgtagaagctaacgttggtgctcctcaggttgcttacaaagaaacctttacaaaaaccgttgaggttgacagcaagtatgcgaagcagtccggcggacgtggtcagtacggacactgtaaggttcgctttgagccgatggatgccaatggcgaagagctgtttaagtttgagtccgctgttgtcggcggtgctattcctaaggaatacattccggcagtcggagaaggtattgaagaagctaccaagtccggtatcctgggcggtttcccggtagtaggtgtaaaggctaccgtatacgatggttcctaccatgaagtcgattccagtgagatggctttccacattgcaggttccatggcgtttaaggatgccatgaacaagggtggttccattctccttgagccgatcatgaaggtagaagtaaccatgccggaagattatatgggcgacgtaattggtgatatcaattcccgccgtggccgtattgaaggcatggatgatatcggcggaggcaagatggtcaaagctttcgtaccgctttcagagatgttcggttattctacagatttacgttccagaacacagggacgcggtaactactccatgttctttgaaaaatacgagcaggtaccaaagaatgtacaggaaaaagttcttgcagataaaaagagcaaataattcctaacaggttccactgggtttcaggcggccacgactgcctggaatccatcaaataggcttgaaaatagtgcacaaatagcatataataaaaaacagcctaacataaaaattaaagctcaaaaagagcataaattaaggaggacgttataaaatggctaaagctaagtttgaaagaaacaaaacccattgtaacatcggtaccatcggtcacgttgaccacggcaaaactactttaacagctgctatcacaaagactcttcatgaaagattaggtactggacaggcagtagctttcgagaatatcgataaggctccggaagagagagagcgtggtatcaccatttccacttcccacgttgagtatgagacagagaagagacactatgcacacgttgattgcccaggacatgctgactacgttaagaacatgatcactggtgctgcacagatggacggcgctatcttagttgtagctgctaccgatggtgttatggctcagacaagagagcacatcctgctttcccgtcaggtaggcgttccttacatcgttgtattcatgaacaagtgcgatatggttgacgatgcagaattacttgaattagtagacatggaaatccgtgagctgttaaacgagtatgaattcccaggcgatgatacaccaatcatccagggttctgctttaaaggctcttgaagatccttccagctcttggggagacaaggttcttgagttaatgaatgcagtagatgagtggattcctgatcctgtacgtgaaacagataagccattcttaatgccaatcgaggacgttttctctatcacaggccgtggtactgttgctaccggtagagtagagcgtggtactttacacgtatctgatgaagttgaaatcgttggtattcatgaagaaacacgtaaggttgttgtaaccggtatcgaaatgttccgtaagctgcttgacgaagctcaggctggtgataacatcggtgcattacttcgtggcgttcagagaactgaaatcgaaagaggacagtgtctggttaagccaggttctgtaaagtgccacaagaagtttaccgctcaggtttacgttttaacaaaagatgaaggtggacgtcatactcctttcttcaacaactacagacctcagttctatttcagaacaactgacgttaccggcgtttgcgatttaccagccggcacagaaatgtgtatgcctggcgataacgtagaaatgtctgtagagctgattcatccggtagctatggagcagggtcttcgtttcgctatccgtgagggcggccgtacagtaggttcaggtagagttgttactatcgttgaataattaaatatgaaagccgaatcctttgtttgcaaagggttcggctttttaaatttataatgattataaaaccagtgcagaatttattctaatgaattgcagatcggaaatgaatgtgctattattgtggcataaaacaaacgtataaaaggatggattttctgttccgattcaggctgatcctttgtgggcggctcttctctttgtgattctgatatagcttatgtgccagaagaaatccagcttaattctcagcagcttttacagcagaataaaataataaaagtgatcaggggaaatatcatgaaggaatgcgttttttgtaaaattattaacggcgatttgccaggctataaaatatatgaagacgagcacacattggcgtttctggatataggaaatgatgtggatggccatacgatcgttattcctaaaaagcatgttactaatattcttgactgtgacgatgagactcttgggtatgttatgaatgcaataaaatttatctcaaatcattatactgtccattgcggatattcaggagtaaacctgttaaatgccagcggaacaagtgcacagcagtctgtatcccactttcattttcacatcattccaagaaaaaaagatgacggtattgacgcatggccggattttaaaggagggaagttttccctggaagacatgcaccatgtattgaagatccagtaaattgcagattttaaatcatgaatgaccaagtcccataccgtgccctcatattcatgtctggcctgttataaagaaggcaggaaaagccctgaatgaggaaaagctggcacaatgaagtggtattgtcataaattgtctattgctggcgcggctgctttgtggtaccattaatttattctgaaaatggaaaaagaggatgtttacgtgataaaagaacggctgcgaaagtggtgtaaaactgcagggctttttatgaccactgccatcatgcttttgattccctgcgtatcttatattctgtttgaatatgtgactggcaatttgcctgcgattcccctgtttatggctgccttaaatataggctggatctacttgttgtatcttgcagttttcgcagtcagcggaagcaccaggatcggcatccccctgactgcggttttcctttacttagtttctgttgcggaatatctggtggcaggctttcggggaaggcccattatgatttgggacgttttggcgctgcggactgccatgagcgtggcaggaaattatgagtttgttttgacacaggaaatgtatcttgcctgtctgggagttcaggctatctgtctctttgcccttatatttcctaaaagggtaaggggcaggaaaaagcgtctggtctttgccgggggaagtgcaggtgtggtctttagcttttgcatgtggttttatacagccttaattcccaataagggccttgaaatcaatatgtgggaggtcagcgagacgtatcaggaatatgggtatgtcctttcaacggctgtttccctcaattatgcggtacagaaaaagcccaaaggctatagcatttcaaaggtaaaacagatttatgattctatcatagaggagaaccaggttcttctggcttcggcaggagatgttgatgtggagagcatagacagcacaacgccggtgaatatcatctgtattatgaatgaaagcctttccgacttaaaagtggcgggagactttgagacgaatcaggaatactttccctttttaaacagcctgaaggaaaatacggtgaaggggagcctttgcgttccagtatttggttctttgaccagcaattctgagtttgaatttttgacgggagattccatctctctgcttcaggctaacagcattgcttatcagtttaatgtcaagccaaatacatatagccttgtgagtacattaaaatcccagggctatgagacggttgcaatgcacccatatccaagagagaactggaaccggcaggagtgctaccggaacatggggatagatgaatttctggcaatagaagattatgaaggcagcgagctgcttagaaactatgtcagtgaccgggcagattatgagaagctgatagaaagggtggagtccaaggaaaatccggaggataagctgtttctttttaatgtgaccatgcaaaaccatgggggctatgagaccctgtatgataattttgaccaggaagtatggctgaccggggagctgaaaggaaaatatccaaagactgaccagtatttgtccctcatgaagcggtcagatgaagctctcgaatatttagtttcttattttgagcaaagttccgagcctaccatgatcgttctttttggggaccatcagcccagtgtggaagatgaattttttgatgacattgcagggatgcccagcagtcttgtggccaataaggaccgtctgatgtggtatcagaccccctttgtgatctggaccaattatgagacccaggcagaggaaaaagggaagctgggggccatttacctgtcctcagagctgttaaaaagggccggggttgatatgactccttatcagcagtttctcctgaaaatggaagagacctttcctgtggtacaccctatcgggtgctacaacaaggaaggaacctactattcctgggaagccttaaaggaaccgggaagtccgtaccaggacctgattatggattatgaatatctggtgtacaaccatatttttgatgggaaaaagttcaaagaaatgttttctttagagaccgacaattaagccggggtgagataataccggaaaaatcagataaaaaggcggctggagcaaaaatgtccggccgccttttaaagtgggaagaatacctttcaatgcccttaagcttccagttccatttccggcctgtaccttaggctgttaaattccttcttcacaagaattacggtccacaaaacgatgattgcgtcaattgccagagagccgtaatatacgccgccaacgccgatccaccttggcagcagcatcatcaccggtacatagaaaacaaactgtctagccatgccgatgatcatagcgggcttgcctttgtccactgacgggaataaggtcatggccatgaaaataaaggataaggcaggaaggatcgccatatacaccctgaaatacaggaagtgggcgcttgtgaacgcctgctctttgagcatcatgccaagaatccagcccggtgcggcaagtgaggcaaaccagaagggcagggtgaggatcagggcagcagcggcgaaaactttataagagcggatgacccggtcatactgctttgcgccgtaattgattccaatgacaggctgtagagcccgcatcagcccgaagatgggggtaagcaggaactggaacacccggtaaaccaccccgtaaaaagcgatatccgccgttgttccgtaccgtgccagggcgttaaacaccaccaggccctggattaaggacatgacggacatgatcagtgaggacatgccaagccgcaaaacagaggttgtgattttcttgtcacctttcagtgagagcagctttgcatggaaggtggctttgccccggccgaaataaagccagcccatcacagtataagccaacatacccacattggttccccaggcagcaccctccacatccatattaaaaattcccatgaagatgtaattgaagacggcattgaccacaagacccacgaccatcatccatgcagctgttttcatcctgccttcggcccggatgatcatgttgccggcaagcccatagatccagaagaaggcgcccgtgatgcagatcctgaaatagctgacgccataagcaagggcttcgcctgttccgcccatcatgacaatgagaggctttgcaaaagcaaaggtcacaagcatgtacagaatggcacatatgacggataaacggttcactactcccatcagccgttcctgggtttcctgatcccttgcgccgatggctatgctcagtacggaaccggctcccacgccgatgagggaaccgaaggcagtgctgatctgggaaaggggataggccagggaaaccccggcgacggccgtatcgcctacgaactgccctacaaaaatggcatccagtacggtattaaaaccatagaataccattgccaccactgccggccaggaaagctgtaccataaccttccacagccctccggtcaggataaattgcttttgtctttctttgattgtgtcactcattatgattcctccccatttatttcttgaaagcggtcttgtaaatccctcctgctccagcccctgctgttctcccgggcggttaagaagtttttgtaaatgccgcccttttccatcagttcctcatgggttccctgttgggcaatgcgtccgtcagcgattactaatatcttatcggcatggcggatggtatttaaccggtgggcaatcaccaggagagtctttcccgcgcacagctcgctgatggcctgctggatgtagctttcattgtccgcatccacgctggcggtggcctcatctaagatcacgataggtgcgtcctttaaaatgcagcgggcaatggagatgcgctgcttttcaccccctgaaagggttgcgccgccttcgcccaccacagtgtcaaaaccatccggaagtgcggtgataaagtcgtagcaacgggcttttttcgccgcctcaatcacttcggcccggctggcatccggccgccccatactgatgttgttgtagatcgtatcctgaaacaggtataccctctggaataccatgctgatatgatccatcaggtcgcttaagcctacttcccgcacatccttgcctcggatcaatatccgcccggatttaatgtcccagaagcgggtcaggagacttgctatagtggattttccgccgccggaaggaccgaccagcgccagcatctgctcctttgataagtcaaaggtgacgtcatggagcacttccttttcgccataggcaaagctgacatgctgaaactgaatctccggaacatttccggtttccggaatgatgtctgtaccgttgtccggaagttccggctctgcaaataccccttcaatgcggtccatgcagctgttcatgaccgtgagccgcgcactttggccatagagagccttcagtgggccgaaaagatcaaacacaaaaagcatgatgcccacgaggaacgttacatccagcaggccgcaggaatttaaataaacggaaagggcaattatggcggtggcgccaaatccgtagaggatattcagacggcgctgccatggtgtatggttttcctcaaacgcaatgctggtgcggcaggtctcacggaagttgtcggtaagtgcctttgatttttctcctatcaggttataggcttttatgatccctattccctcggtgaaatccagaactgcctcggtcaggctttcgctctgttcctgccggatagcggaatccataagcgcctcttttttcagtccctttgccgtcagaagcagaagcagcacaattccaatggccgcaagacccagccatatattaaacatcagcataaataccagcataatgccctgggcaaagatataactcatcatatctgccagcactgtcatgcagttttcttcgataaacaccatgtcagtggaaagaaccgagctgattttgccgatattgccctcggtaaagtaccccatgggcatttttcgcagatgcctgcccagctccatgcgtttctctgcaaataccaggaatcctgccgccgattgcagacggtcggcaatgtgatggaacagcatttgaagcaaaaggcaggctgccatggcaaaaccgatccacaggcacatttctgtggtagccgtaccgtgataaaaggcggcaaggacgaaaaatccgaagccgatgggcgctttagccagaattgattttaaaaaggaaaatacaaaggccagcttgatcctgccctgataatttcctgaaacagcgagaatgcgtctcattaaagcgatcattgagcatttcctcctttcgcagtggtgaccttccactgggcgctgccctgggcggcctgccagagtctttggtagacagggcagctgttaagcagctcttcgtgggttccggcagcggccagccttcctgagtccagaacacagatctgatccgcgcctactatggaatgcaggcggtgggcgataacaatgacggttttcccctgaatgacctgggcaatagcctcattcatcttttcctcattttcaggatccataaaagcggtggcttcatccagaacaataatgggtgcattttttaaaatggcacgggccagtgagatacgctggcgttcacctccggaaagctgctttccgccgtcacctgcaatggtgtgaatgccgttttccagcctggccagaaattcgccgcactgggccttttctgctgcttccatcacctgggcatccgttgcctccggcttgccgagacgaatattttccaaaaggctgatgttaaataaaaactgttcctgggcaacataagagatttcattattaagagcttccagactcatgtcccggatgtcctgttctcctattttgacagcacctccggtcacgtcataaaaatggaccagcagcttggcgagggtagacttgccgccgccggattcccctaccaaagcggtcagcgtgccctccggtacatccagtgtgatacggtgcagaacgtcagcctccttgtaggcaaagcgcacatcctcaaaacgcaccccatggtcctttccggtaaagggcttattggattgctgaaggggcggcgcgttcagcatctgctccaggttggtgattttatgattgatctgaggcagtgtggacataaagccaagggctctgagaagggggcctcccaccccaaaggacatacacaaaaccagggccagatccggaagtgtggaatatccctgaatgacgaagtaggaacctacgggcagaacaaaaagcgccacgcagggcacaaggctggaataaagcgccatccagggccagcaggccttataccatgccagggtgaaatcccggtagctttttacatctccctcaaaccggtgataggactccccatcccggttgaacaccttgacgacctccatgccgtttatgtattccacaatggtattgttcatcttctgtgccgcagcatagtaattgcccatatctttcatgccgatccggtacatcaccatcatggcaatcattccaagaggcagggagcacagggccagaagagccagcttgggatccacaagaaacattccggcaaataccagagccgggatggccaggtttgcaattccctcaggaagcgcatgggccagcaaaagctcgatggtttcgatgtcgtcgataaacattttctttatggcgcccactcccttttcctcaatagcgccaaggggctgcttctccagcttgccctggagggagatgcgcagatttttcagcgtgttgtaggctgaatggtgagagagggaaaggccccagatatagaacagggcatacagcagtgcgcagatggcgatggcggcgatgcgccaggccacatacccgcccgtgatttcctccctcatgagcagcgggcggatgatctggtagatgaaccaaaacggcagtacgttcatgaccatgcctatgagcatggcggcaattgcccggtaggttgttttccggtaatcacctgcatattccagcactttttgaaacacgttcgttacctcctttatattttatataagttagttaaaactaactaacagataaacaggaacccctccgcaggaggggctgcggggcgttaaaaccccaaaacctggcgccagttaaacaggccgcagatgagtttgttatgggattctatctgttcccatgtaaaatcgtggataaacggctcataaattgtcgtccagaatgcagaaagcaggatatgaaactcctcaatggaggtgtttgtgcgggtcagcccccgtttttgtgcttccaggaaatactcataagtcttttcagtcattttctcaacccagtcatgctgaaagttggaatgggccgttccctccgcacatgttaagagcagaataaaaccgtcgcggtattcatggaagaaccggaaataatccaacgtgttttcttcgtccatatcccacgcctttaccaatgcgtcatcggacagggagctggcttctaccttgcatcgctgttcaataaaatcatcaagtgctgcaaccgtctccgccaccactgcgttaaacaaggcttcctttcctttgtaccgcttatacagggcacccgtggtgattccggcagcctcgcagatttcctttaaggatgcattctgaaacccatgtgttaaaaatactttttttgcgctgcttagaatccgcggatcaatggaacgatcaggtttggacatttgtctgttttacctcctgctgttatactgataatctgattatcggtaattcgattatcagtttatcaggtgatttatcatatgtcaagcattatatacagagtttggttaccttttttaggttcacatattcatttggccttctttgaaatatcccgtatttgcagcattttaatgcgttgaagcgtacggtccttaaggtttttttacaaatacgtaataaaaacgttattgtaaaaagcaggaaaattggttatcattgtaaagaacctgattaagacaacatggagggatgcgaaaatgaaggaaagaaaaataggcagaaccgtgaccggatttttaaccgctgcatttttatgctgcgcttctgcctttgtttcattggcagatgcagatacagccgcagacacagctgcagccgcagcagtacaggcggcgattcagtcctgcctgatcaattctgataagaacagcgtgacagttcaggcagaaatcaatgccgatatgacgggaacggatggcgtcctctatctggtagaactgcagccataccagaataatctggacggcagaacggattacgcggcttcttcagcgccgggaggcaaggtcagctttacgtttccgttaaaccgcaatacggctgaggacagactttacagcaaattcgtcattgcagtttgggatggaacgaaatatattgaaatcagcaaacctcattatattacaaatcctgagatggttgcggccaacacccagccatttaatgatccccttaccaagaagggcttgaatatccagctgaacatgctgggagatgcctttgaattaggggtgaagcacgttgcaaccaatatttctttccatcagatcctgggccagggaattgattaccagtacgatggaaagacctaccatttcgataaaaatgccatcacaagctacgatgagaccatcagcgcactgtccgggaaaggaatgacggtaaccgccattattttaaatggctggaatgatgccacaccgaacttaatctaccctggaacaaagaaaaatgccaatgcattttactatatgttcaatccggccacccaggaagggcttgaccagacgagggctattgcctcctttttagcggagcggtacaatggttccaatccaaaccacggaaagatatccaactggatcgttggaaatgagatcaacaaccagcagtggaattacatgggagaaaaggatattaccagctatgtgcaggcttaccaggatgccttccggatcttttatacagccatcaagagtaccagcgccaatgacagggtgtattattccctggactacaactggaacaatgagatcgataataagctgaaatacggcggaagagccatcgtagatacttttaactccattgccaatgaacagggacagatggattggggcttatcctatcatccctatccctgccccatgacggagccggaattctgggatgatgaccagaccggactgatcaccaatgattataactctcctgtcattaactttaaaaaccttaccactctgacggattacatggctcaggatccattaaaatctcctgccggccatgtgcgtcacatcattctgacagagcagggctttacggccaccagccagacaaggggcaatgtggcccagattcaggcagctgcttatgcttattcctattacatggttgacagcaatccttatattgacgcttacatcttaagccgccaggtggatgcccctctggaggtgaggagcggcttatcctttggactttgggaatgtaacatgaacaggggagacgatattgtagcaacaaaacgccgtaagatctggcaggtgttccgggatattgataaaaagaaatataccctggaatcaacggaattcgccaaatccatcataggaattgagaaatggtctgatgtggttccaaacttccggtggagatcattggagaaataatagcaggaataaaaaaatcatgccgtaacggtatgcagtgaatatcggccttttagcattaaaaccgcctttaaaaatattttaaaggcggttttaatgtgttaaaaacaggctggaagggaagtaaccgtatgaaagggataattaaatcaggaaggctgaagaatgcaaagaaaaataggtaaagtctaagaatgatcgggggtctcatcattgacaaactggtatgattctaatacaataatggttagcttttactaaccgattataattgattttgttttatatgaaaaggagagagtatggaattaaagcagctggaatattttcttgtggcttgtgaacgcggaagccttaacaaggcggcggaagcattattcacatcccagccgaatgtcagcaaggcgatctcagcattggaaaaggaactgggctacacggtatttgagcgtacgagcaagggacttcgcctgacagaaaaagggaaatccacgcttacatacgcacaaaatattgtaaagaatctctctgttatgaagagcctcaataaattcaatgctcctgcggccctgtccctgtcctcttaccccagcaatatgattgctcacattcttgtggacttgtgcaaggagaatgcggagcttgtcatgcggcaccagcagggatctgtggaggaaatcacaagtcaggtggggtgcggggaggctgagattggaatcctgtatgtggcgcaaaagcagttacaggcattccgccacatcattgcccataaaaagctggaatatcaggaattggatatcaaagaagcttgtatctatgttggtccccatcatcccatgtatcaacgggattccatcgatatttccgagcttggaaatctgcgttttgtcaggggaacacaagaatatttttccatggaacatcatcttgagcaggtgagtcttggaaccatcagcacggaacagctgcattatgctgcacttaccaacagcgatcacctgaccattgacctcctgttgcatacagacgtatgcagtctcagcattaactttatgtgttccaagtacgagcagtatgatatccggatgctgccaatccgaaactgtgaaccctttttgtccattgggtatgtttacgagcaggggcatgagctttctcctattgcgcgaaaatttttacaaaactttcaggctgcgttataacatattggaataacgcagcctgcttttttggtcactggttagataagcctaaccgatgtataatatttcctgctaaaactatttcaaatgagacgtgaggagaatattatgaaaaaacatcgttttggagccctgctcctgacaggggcactgtttatatcgctgatgactggctgcagcggcaaggctgcgcctgaagtttcaacaaatacccccaatgattctgtggtatcggacggaaaaaaagaggaactggtttttgtcaattaccgggatatccgtgatttaaatcctcacttgtacgccggtgagatgtatgcacaggagatgctttatgaaagtcttgtaaatattacggaggctggttatgaaggctgtctggcagaaagctgggagatcagcgaggatggaaaggtttatactttcaaaatccgggagggtgtaactttctctgacggaacggcctgtgatgccaacgccattttagcaaacttcaatgccattcttgaaaacaaggatcgccatacatggctggagatgatgaatctgctggtaggggtctccgctcctgataataatacttttgtgatccaattgtctgagccatattatcccatgcttacggaacttggagttacccgtccctttgccatgatctctccggcagccatgaaggatggcagcaccaaggacggtgtggaagcctacataggaacagggccttatgttctgagcgattttgtaaccgatgaatacgcaatatttgaggccaatgagaattattggggggaacagcctgccattaagaaaatcacggtcaaggtgattcccgacaaccagacccggattttggctttggaaaaaggtgagatcgatttaatcttcggcaagaacatgatcgatgccgacgcagtcaataagtatgtggacagtgagaaatttaaggtgtccttatctgatcccacctccaccagacatatcgttttaaataccgccaacagcatcttatccgacactgccgtgcgtcaggctttgcagcacgccaccaaccggcaggccatctctgacggtattttctacggtttggagcagcctgccgacaccctgtactccaccaccattccctattgtgatgtaaacctgaaaccctatgcatatgatacggaggctgccggacaaatgcttacggatgcaggctggatcctgggaactgatggcatccgggaaaaggacggtaagaagatgacgctggctctgctgtataacagtgacagtgtgactgaaaaatccattgcagagtatctgcaggctgaatacgccaagctgggaatcaaaattgatatcaccggccaggaggagcagtcctaccgtgataacatgaaggccggtcactttgacatggtgtttaacatctgctggggcacaccttatgatcctcagtcctccctggcagccatgcgcgcccctgtatacggcgactacgctgctcagcaaggtcttcatgacaaggctgagattgatgaagcgatcaccaatattctgatttctaccgatgaagagaaacggcaggagctgtacagcttcgtgctcacccgccttcacgaggatgcggtgtacattcctctgacctttgagtgcaataaggctatttaccgcaccgatctgaagggggtaggcttcactcagactcagtatgaggttcctttcgcagatatgtattactaaaacatgagaaacaaggatcacctttcttttgaaaaaggagaagcctatgaagcattatgtcatcaaacgaatcctggcggccatcccgctgcttctgtgtatttcgtttatctgctttgtatttattaatttaattccctctgatcctgcggaggttgctctccgtgtacgtcaggtaccggtcattacagaggaggccattgcagaggtacgggcagagctgggactggacaaaccttatctggtgcgttatgctgactggcttctggaatgcctgcggctggactttggcatcagctataccaatccctcccgcacggtggcaggggaattgctgcgatgtctgcctgccaccctgatgctggcaggcgcgtcactggtactggtcatcctgctgagtctccccgtgggatttctctgcgcggtttataaggacagctggtttgaccgtctgacccggggttttatctttatgaccactgccatgccggcttattgggtgggtctgcttctgatgtggtttgtgtccatcaggctggatcttctgcccaccagcggaagcggtacctggaagcatttgattctaccggcgttcaccgtatcgctgacctatatttccacctatatccgtctgatccgcaacaatatgctggaaaatatgagagaagattacgtgctttacgccaatgtgcggggactgacccaaaggtcgattctcaccaggcacatcctgaaaaattctctgcatacctgtattgtagccattggtatgagcattccccagctgattgccggcacgattgtagtggaaaacgtatttgcgtggccgggacttggcaccctttgcatcacttccatctttaaccgggattatccggttattcaggcctatgtgctgctcatcggggtgttgtttgtggtttttaatctcctgttcgatatcctgcagacgctggcagacccgcgtctgagaaacgaggtggcctgaccatgatgaaaaaattccttggaaacaaggtggcggtcctgaccactctggtggtggcggcagttgccctgctgggccttatggcccctgtcattgcaccccatgatccctatgaaacggacattcttaataaatttgcggccttcagcgccggttatcctcttggcaccgaccatttgggacgctgtgttttatcccgtatgctttatggtatccggcctaccctgggacttgcggtgctgaccatgctggggaccatcgggctcggcgccctgatgggccttttggccggttactttcggggatggacagacgagcttatcatgcgggtggtggatgtgatgctgtcctttcccagccagatcatggtgtttgccgtggtcgctctccttggagtggatgtacgcaatgtcattttagctaatgtctttattaaatgggcctggtatgcccgtatgatccgtaccggagtcttgaagtaccgggaccggaattttgttctcttttcccggtgcatcggcaaccgggagagctttattctggggcggcatctgctgcccagcattgcctcagaaatggcggtgctggcatcactggacatcggctgggcaatcattaatatttctaccttatcctttcttggccttggggtccaggcacccactccggagtgggggcaatgctcaatgaggcaaaaaatgtactcactaccaatccggtgcagatgctggcgcccggcattgccattgttattctggtaactgcatttaatctgctgggtgatgccctgcgggatgtgctggatccaagggaggcggcagtatgaacataattttagaggtatccggcctttctgtttccctaaggaagaggaaagactcccagatgatactggaaaatatcagttgttctgtccggaaaggagaatgtctgggaattctgggagagagcggcagcggaaaaagtatgacagccaaagcgatcctcggattgctggacgatgattttgcagtatcaggcaaagttctgtatcagggaaagaatctgctggatcagagcggggaagccctgcggcagctgcgcgggaaagagattgccatggtgctgcaaaatcccatgacctgctttgacccgctgtacaggatcggctatcagctggcagaaactctggcggtgcatacggactggagcaaggatgagatttacacacggtctgaagaaatcctccataccatgcagatccgggatcctgccctggtgctggaaaaatatccccaccagctttccggaggtatgcttcagcgcatcatgatcggcctggctatggctttaaagcccgccctgctcattgcagatgaaccgacgacagccattgacgccatcacccagtacgcggtcatggaggagttccggaaaatcaagtgtgaacacggtacggcaatgatattcatttcccacgatctgggagctatctcctgtgtggcggacaagcttttggttttaaatcagggtaaagtggcggatcaaggcagtttccgccaggttctacaccacccggcagatccgtatacccgtctgctcattgaaaagagggcggcggtcatgggaaaataccgcaccgcgctccagaaaggagaggtgatctatgcttgaactacgcgatgttaatgtcagcttccgcagtgagaggcaggataccctgctccgtaccaagcggcagcaggtgctttatcatgtatctctgactgttccggaggggtgctgcctgggtgtgctgggagagagcggcagcggaaaatccactgccggccgggtattgtgcggtttgctgaagccggataaggggcaggttttgtttcgcggccaggatatctatcgcaccaaaagcggccgccgggcgttacaggaatccatcagtgtcgtgttccaggactacaccacttctgcgaatccccgctttcatgtgagggatatcattgccgaagggctgatggtctatcagcgccgcacaggcaaaagacttgatatttcagaagaggtcacggccctgctggagcaggtgggcttagatggcagctatgcctcccgctatccccatcagctttccggcggacagcttcagcgggtatgcatcgccagagccatcgcctgccggcccaaggtcattttgctggatgaggccatcagttctctggatgcccacactcaggtgcagatcatggatctgctggtggagctgaaagaccgttatggcctgacctatgtgtttatcactcatgatctcacagccatcacttatctgtgtgaccgggtactgttcctgtatcagggacagataacagaacagtgtgaagtggcggaaatcgcaggagtgcaggacagctatgcccaaaagctgctgtcttccatcattgactttgaggaggtttcttaatgctgttttgtaaccttgcttttcagccaggcgaaaagaataaaacactgcttccggtaatgccgggaacagacattccggtttgggtggtctgcgggaaagaaagcggccccacgctggtggtgaccgccggtgttcacggatgtgaatttgtgggcattcaggcggtgcgccggttttatgagcacattgatcctgcaacctttcgggggcggcttattatgctgccgctggtaaaccaatccggtttttatcatggaaaaaaacagattgtacccgaggatgggaagaacttaaaccgggtctttccgggggaccgctttggtaccgtcagccagcagatggcttatgtcattgagcaggaaatatatcctttggcagactttcttgtggatctccatggaggcgatattaacgaggcccttacgcccctgatatttttcccggccgctgtggaggagcatgtcagcacccgcacccgggaggcagccatgcatttgccggtaacctaccgggtacggtccacctcaggcaacgggctgtacagctacgcagccaaacgggggatcccgtcatttcttctggaaatcggagggggcggccgatggagggaggaagaagtggctctgtgccaggtttgcttaacacggctgatgggttatttgaaaatgagagatacggctcagccaaatccgggccagctggaaggggtggaagcggtctatgaggaggcggaagccgacggtttctggcagccctgcatcgcaccgaaccagaatgtccaaagagggatgctgctgggtcagctatgggatttagacggacggctgatccgggaatacaccgccggtttgaatggtgttgtctggtatcatactaccaccctgggggttcaaaaaggagatcctttggttgcttatggccgatgtgaatgaccggattcctgtttgggattaaacaacaaaaacataaactgcaaaagcagatgctgttaaaaatcatgacggcatctgctttttccttatgtgctaaaacatcatattatgaaaaaaagtttcataaactatcaagtatattgaaaaaataatacaacaaagctagaatgtaaataggtaaaaaatatgtaaatttcttctggctttacagaaaggagaagaaatgtatgaaaggtttacttgtaaggattgacagctatatccaaaatgcgggagaagcagaaaaagagctgataaagagacttcataaacatcccgaatcagtcctcagaaaaagtattaaggagattgccaaagaaacctatacttccccggcaacggttgtgaggctttgcaaaaagctgggctgtaaggggtataaggattttcagaacaccctggcctatgaggtggccttatttcaggagagcaggaacattgcgtttcagaagatcacgcgggaagattccatggaagacattatttataaggtcacaaagaaaaatattgaatccctggaaaccactcagaagctgattgagccaaaggttgtgacagaatgtgtaaagctcttggaaaacagcagaagcgtcactctgttcgggctgggaacctcccttttagcggcaagagatttgtacttgaagctcttaagggctgatgtgctgtgcaatgtctgcgatgactggcatacacagctgctggccgccagaaacttaaaaaaaggcgatctggccattgccatcagctattccgggcttacggaagagatccttcaatgtgtaaaggaagcaaaaggaaacggagcaaaggtgattgccataacaagggcggtggaatcggaactggccttggaagcggatttcgttcttcctgttgcggcaacagagctgatacaccgaagcggcgccatgtcatcccgtatttcacaattaaatgtaatagacattttttttactgcttatgttaatagaaattatgaaacctgtatgagcaaattttcaaaaaattatatacagaagaaaggaagtacagagcatgattgatttatcagtgctgacaacagaatcccgtaatccggataccatgaatctggatgaaatgacgccacttgaaattgctgctgtcatgaacaaggaagatgaaaaagcggtaaaagccgtagaggaagtgctccctcaggttgcgacggcgattgaatgggcggcagagagtctgaatgcaggaggccgtatcatttacatcggtgcaggaacctccgggcgtctgggagtgttggatgcagtggaatgcccgcccaccttcggggtccccagggagatggtggtaggcttgatcgcgggcggagaaaaagcctttgtagaggctgtagaaggagccgaggacagtgagaacttatgcgaggaagatctaaagacggccggcctgacttcaaaggatattgtgatcggcctggcggcatcaggcagaacgccctatgtaatctacggccttgattatgcaaataaaatgggctgccgaaccgcggccattgcatgtaacaaaggatctgatataggaaaaacagcacagcttgccattgaaccggtgacaggacctgaggtattaacaggttccaccagattaaaggccggaacggcacagaagatgatcctcaatatgatctcaacaggaagcatggtggggatcgggaaagcttatgaaaaccttatggtggatgtaaagcagagcaatgaaaagctggtggtaaggtcccagaatatcctgatgacggccaccggatgcagcagagaagaggctgaaagagtattaagccaggcagaggggcatgttaaaactgctgttgccatgattttactggattgcggaccggaggaagcaagacaaaagttatcacaagccggagggaagatccgagaggctttgagataaaaagaaaggagttttaaggattctttttaagtgtaatttaaataaaattattaaaggaggattatcgtgaattacaagcaaatcagtgaacaattattaacgctgcttgggggaaaagcgaacataacttccaatgctgcctgcatgacaaggcttcgtgtcggcttaagagatacatccaaagctgatattgaaggtgtgaaaaaggtagagggagttcttggagtggtggaaagcgacaccatccagattgtatttggtccgggaaaagtaaacaaggtattggacgaattttacatgcttacaggacttgcaaagggccaggcggaaaatggtacggagcaggatatcaatgaggttgcaaaggagaacaaggctcttcaaaaagcgaaatatgataagccggtccagaggtttttaaagaagatctccaatattttcgtggctctgcttcccggcatcattgctgcaggtctgatcaacggtatttgtaatgttatcaatgtttctaccggcgggagccttttaggagtatggtggtatcaatgcatccggaccatgggctgggctctgtttgcctacctgcccattctggtgggatacaatgcggctaaggaattcggcggttcaggcgttcttggggccattgcaggagccatgtctattgcaaatcccgggatgcctttgcttgctacggtaaacgatgcccagatactacttcccattaccaatacagtatttaatccggcatcaggcggacttttggctgcgctgattgcaggcgcgttcttcgcctttcttgaaaaaaacatcagaaagcgtatgcctgacattattgatacctttataagccctcttttagtgcttatcattggaggcatcattgcactcctggtaatccagcctttgggtgcaggattaacaaaggtgatctttgccatattaagttttgtatatgaaaaaatgggcgttgtcggaggttatattttatccgcaggcttccttcctctggtggctgtaggcctgcatcaggccctgactcctattcatgcccttttaaatgatcctgcaggcgcgacaaagggaatcaactatctccttccaatccttatgatggcaggcggcggacaggtgggcgccggtattgcattgtatgtgaaaacaaagaacgtaaaattaaagagatatataagggattccatcccagtaggtattcttggaatcggagagcccatgatgtatgcagtgacgctgccgcttggaaggtcctttattaccgcttgtgtgggtgcaggctttggaggagctgttgcagctcttatgcaccttggtacggtttcccagggagtatccggtttgttcggcttgctgatcgttcagccaggccagcagattggctacatagtatccatgctcatcgcttatgcaggcggctttctggtgacctatttctttggagtggatgaagacagaatcaatgaagtatatggagaataaatgaatacaggaatttcaatatatttttcaaatggaatggaaaagaatgaacgcctgataaaaaaggcggtggaaaacggagtgaagtatgcctttacttcactccacattccggaggaaacaggagtggattaccgccgggatgtacaaaggctgctggagatatgcagggaaggccagttaaacctcattgtggatgtgggcccggaaaccctggaaaagttgggaacaagcaatatctcggagctgaaggaccttgggatcacccacgtccgccttgattacggctttgatgccaaagaaacggtacagatatccaaagacttttatgtggtatttaatgcctccaccattatggaggaagagcttttggagtggaaaaggtatggagctgatttcaccagatttgcagcgtgccataatttttatccaaagcagtttactgccctgtcccttaagcagacaaaggaaatgaaccagaggttaaagtatcttggctttaccaccatggcttttgtgcctgggaatctggaactgagaggacctttgtttgaaggacttcccacagtggaagcgcacaggggaaggaaagaccaggtacttttaaacatgctggagctttattatgagggcttctgcgatgtggtgctgatcggcgatgtggatgtggaagaacaggactggaaggatattcaatgcttaagcaatgattatgtagagcttaaggcagacatccttccttcctatgattatgtaaaagacatcattcatcatgacaggccggattccagcgagtacgtcatccgttcccaggaatcgagacagtataagcagaaaatcaggcctgagaacgagaatcaggcacaaataaggaatcagggaagcatttgtatttccaataaaaattatttaaggtatatgggtgagcttgagattgccagaattgacctgcccggggaagacagggtaaatatcattgggcaggtgcaggagactcatatgaaatatttgccctatattcaaaaaggtcttggagtgaagcttgtataattttttccctatgctccggtctttaactaaggcgccgtaaaataggaaagattacaataaatcaacagaaaaagtttatataaaaaggtctgtaaaccgggtattaccagtgtttacagaccttttatatattaatagctattatcaattggtgtaaaataaacgatccgatgcatgttgatcccttagatatatggctattttagttttatcaacatattgttgtaatttgtatacttcgccgcagctgcattgcctaatttactgccaggacagggccccgtaggcatccaacaggcctccgcttaccatctttcctgtaagggtatccagttttctgctggaatttaaaagaatattttttacatcagacagggaaatatccggccggtaagaatagagcatggcggccacacctgttaccatgggcgctgccatggaagttccgctcataaagccataggcatctccgggaaccgtgcttaagatatagctgccgggggcggctatgtcaacgctgttggcaccatagttggaatccttgcttaagcttccgtcaaataagaggtttgcaacggagatcacgttatcataaggaagggaagccggataaacagggtaaatgtctgtatcatatccaagtccggagattccaccgtttccgcaggaaaccacaaataacatgctggaatttttaatagtctgtgccagttcttcgctgtaggcggtggtacccatgcttaaattgcagatggaagcgccgtgtgcttcggcataatggattgcctggatcaccgtttccggggagccgacacccttttcgccgccaagggcttttagaggcatgatcttcacataattattatccgtgataccggcaatgccgtaggaaccgcggacagcaccgatggttcccgctgcatgggttccatgagtatcctcactgccggaaaagacctggttatttccggaataaaagttccagccgtgcacatcatctatgtatccgttgccgtcgttatcaattccatctccatcgatttcacctggattggtccagatggcatttttaagctcaaggtgattgatgtcaatgcccgtatcaatgatggccacaatgacggatcgcttgttcactgcctggtcgtaaagcttccatgcaggctgtatgttgatgtcaactccggtggaagctccgattactgtggattcaaaatctccggggccaggggtggaagcaccgctgcctgatttccgtccatcgtaaatgttatcaattgcttgaaatttggatttcagctcaacaaggcggaattccccgtcatttttcaatccccactgataggtggaaaattcatccgagggggataggtttatcaggccggggccaagggccagagcatgcagttcttgtccactctgggaagaatatgctaaaagcgggctgtcgaaggtcttttcagggcctatcccggaagagggactgttaaaatagggcaggcctgtaaaaagaagagcgaggatcagacaggcagcgcaaattgtttttttcataatttctatctccttatatgtgaaacaatcgttgaaattgttcctattatatcaaagtgccggcttactgaccagccctgcacattaatacggttactattaacactccttttcctttttaaattataatacattgtaaagaatcccggccagagcagcaggagtttgtctcattctgtgttttggggcagcgccggatttggtgcttcgtttaagcattataccataaccttacgctgtaagcttgaaaaatatgtgaaaattattttaatatttttatatgagaaatgcccggccggagccgggcattgtctgatgttattcaactgattccagtggattcttttccatctctgtttctggggctttatctgcctctcttctggcaagttccgcattggcttcggcctgtgtgatggtcccggcatctaccagcttctggatctcgtcctcggtcagagtggagagatctttgctgctgtctccgctttctgattcttctgtctgggaagcgggttttgcagagggcgcaggtttgttcccggttactgcctggctttcctggaatgctctgccttcactgctgatttcaatggtatccacgggagccgaggttacggtacgggtttcctgggtctggccactgctttcatttccgattgcctcaatctgtgcggcttctgctgcgccggtttttgcagaggctgcctgtgctttttccttctgggcctgaaggagctgccattcttcataggatgaaggatttgaaattcctgagattcccatgattctttcctccttatgtaattttataacgggcatttgttaaataccggactcccctggttttactggcgctctcacatttttatataaatgctctcttcacccgcgataaaatagaattatcatgatccatcaggagccggaagcctttcgttatctgaaaaaacaatttaaccgaatcaagtaagtccctcacttcaaatgcaaaatgtattaagtttggggaggggacttactccgatcaggtgtagtacaagctccgcctgacaagcagcgatagctgctattcggttatgcccgataaagcggggcacgccgtgaacaaatagcgaagcggattgcgaatatccgcttggccaatgatgtattattatataaggaaagaatatcactatttactgaaaatagtctgaaagaagtctggaaatctactctgcaagaattaaaaacggctcttcacgccgttctgattccttatcagagtttcccgaagatttccagaggatgtgggaaataaagtctctttctcagtagttgccattttgtacgtcaaatgataatataattctatatatcgttttgcctttgatgggaaaagcgggaaaggaggggcctgtggaggaaaagagattccgcaataagattaactggtttacattctttttcagcgttctggtcatatgggtccattcctacaatgcagttcttttcctgggtaagaccaggattgcttatgaagttgatgctctggaacgttttttgggagaccaggtggctcagatcgccgtacctggattttttcttatatcctcctaccttttcttcaggaattttactttggaccgcctttggatcaaatggaattccaggatcaggagtgtgctggttccctatatcgtatggaaccttttgtattacttgggctatgtcatagggagccgtttgcctgcaatgtccggaattatcggaaagggaaggatccccttccgctttacggtagcagcagacgctgtccttcattatacgtataactatgtgttctggtatttaaaccagctgattgttttgattcttctggcaccggtgatttaccttattatcaggaggaggctgacaggagttatgcttctgaccggaatactggctgcaatttacagcggcggcgctttgcctcttgtgaatctggatgcccttttttattacagctttggcgcctttgccgcagttgtggagagagagcttgccgaacagacctggaaccggaaaagccttctggcagggctcgccattttagctgccggacttctcataaaggacttagaccttcccggaagcattaagggtgaggttgccgcgacaactgtaatcttccgcctctttattccggtaggcttatggctcctggttccggaaggtcttttgggagaggcgaaggattggatgaagcagaatttctttctctatgccgttcattttgccatggtgcgtctgataaataaaacgggagcatttctgctccctgcatttccggcgctgccccttgggtttttcctgcttatgccggtattgtgcgtgatattcagttactgggcaggcctttttttacgccgttaccttcctgttttgtggaatcttcttaacggaggccggtgagccctcttaagcccaccatctgcctgaggccccgcagggaagaaccagtccggtccgggtaacaggaagtcccacttcttcagattgtacggtgcctccgaatttcccgccgatttcggtggaaatcatataggaaagtacagaaggtgccagccctgtggtataggagttgattaagaagaagagaggctggtcggacagaagctgggagcaaagctttacaaagggataaatggagtcttcaattttccagatttctccctttggccctcttccataggagggaggatccatgatgatcccatcgtaatgattccctcttctgatctctctttctacgaattttgcgcagtcatccacgatccagcggatggaagcggactccagattggaggaacgggcattttccttggcccagccaaccattcccttggacgcatccacgtgggtgacagaggctcctgcctttgcagccgccagggtggcgcctcctgtgtaggcaaataaattaagcacctttacaggccgtccggcctgtttaattttttcactgaaccagtcccagtttgcagcctgttccggaaagagccctgtatgcttaaagctgaagggctttaactggaaggtcagatccttatagctgatggtccactgttccggaaggtcaaaaaactcccactccccgccgcccttggcgctgcggtgatagtggccgttcatctttttccagcctttctccgtcctgggagtggaccagatcacctgtggatcagggcgtacgaggagatatttcccccaacgttccagcttttctccttctgaacaatctatcacttcataatctttccagctgtctgcaatccacataatcggtgccgccctttccataattaataaatagtagtttcatcaaatgattccatagcgtgatttactgatcaaaggcaagctaagagcaggctgaaagcagtaaattagccgttcaatgaaccaaaggtaaattgaacttccttgattatactggatagaattaagagcgtcaagtacaggcagagtcatgagaaaagcccctcaatcacgccttgtctatatgttctatataatatagtataaattgaaaaatgaggtgtaaatttatgtgctgttttaatataggctttaccgtcggtaactgcggctgtaaccgctggtgcagctggggaatcaataacggctgcggcaactggggctgtaataacagctgcaactgtggatggaacaatggctgtaattggggctgtaataacggctgtaattggggctgctgcaaccgatgcaaccggtgcaacagatgctgcggcaactggggctggaacaatcgctgtaattagtggaaaagtaatgctcttttttctatatttatatgaagtttaaggcaaggtctggttttaccggacctgccttattttttaccttaaccagagttcacagttgatggaaagaagatgagctgtgctttcgaaggatgaaaccatgatatagaaaaatttcggaccagataaaagccaaagtgataagagaagtagggcagaacaaggggagaaataatttcgtaatagaattgaaagattaaaacagttgaataatctaagattaattgttaaaataaatattaacagaaaaggaaatccctgtaaggagtgaagatatgaaaagaaaaggtctcatcatgctggctgttaccgccatgctggcgattggtgctgcatctatggatgcctgggctgcggaaggttgggctcagtcaggaagcacctgggtttattatgattcaagcgggagtaaggtgacaaacacctggaaaaagggcgcggacaacctgtggcgttatttaaacaccaatggcgagatggctgtaaacacctgggtggaaaatacctactatatggactccaacgggattctggtcacggataagtggatgaaattccaggattcaggcagttccctttacaaatggtattatttcggaagcagcggaaaagcgattatggataactggtccaagatcaataataagtggtattacttcgatccaaacggtgagatgcagaccggctgggtccttgatgatatgtattattgcggaaccgacggagccatgcgcaccggctggcagaagcttttttcaccgaacagtgattacgacggggaccgtgtcactcccggggataatgatgacggaaaattctggtactattttaatgacagcggcaaaaagtatgttccaaaggatatgtccggcgattatgcaacctataagatagacggagttgcttactgctttgattccgatggagcgcttcaaaccggctggaagaacgtaggaattgataatgccgaatatgacatccagaattataaatattatgacagcaacggaaagctgagagtgggctggtattccgtggaaccgcccgaggatttgtccggctatgaagagagtgtggagtggttttatttttccaattccggggttccaaagaccggaccaaaggagggagaggccagcacccagaatttaaccaagataaacgacaagacttatttgtttaatagcctgggcaatcctgtatatggactgcagaaggtgaacattggaagcacttcagagtatactgccttctatttcggagataagaagaccagcaccatgcaaaagggcaaggttaaggtgatcgaaggggatggcagtgatgccacctattatttcagtgacagcggccggggctataccggagtcaaagacggttccttatattatatgggcaagcttcaatgtgcagatgaaggaaccaagtatgaagccattgccattcctacgggaagcactaccaccacttatgtggtgaacacttccggcaaggtggcaaaaagcacaacggtaaaaaattccgaaggagtgaaatataagaccggaagcaacggaaatttattaaaggtggatgatgaaacgccaagcggagaaggcagaacccctacggaaccggtctgggaataagaaaatcagggatcatatttagcagcagaacgtattttacgttctgctgttttttcagtaagatgctgtcagcatcctaaattgatgatactgaaagtgaaatcagtttggaaatcttgacagagaaataaaaaacttttatactgaccttgcaagggcattctcgaaaacccttagccaaaaggaaagataaatcatgaagaaaccacttattttacagtcggattttggaatggcagacggcgcggtcagcgccatgtacggagttgcttacggcgtatcaggagatttgaatatttcagatctgactcatgagattccccagtatgatatctgggaagcctcctaccggctgattcagactgtgggctactggtcagagggttcagtttttgtcagtgtggttgatccgggggtaggttctaccaggcgcagtatcgtggtgcggacaaagaacgggcaatacatagtttccccggataacggaaccctgacccatgtaaagaggattaccggcttggaaagcgctcgggtcattgatgagagtgtcaaccgtctccccaattcaggtgaaagctatacctttcatggacgggatatttacgcttatacaggagcaaggctggcagcagggatcatcacttttgaggaagtagggccggaggttcccacggaaagcgtcattgagctgccggttgtggaggctgtctatgatggagaaaaggtaagcggaaccattgatgtgctggatgtgaggtttggaagcctatggacaaatattccgagagcgctttttaaaagcctgggagtaagccacggcggaagggtggaaatcagcattgaaaatgagacccgtaccttatataaaaacattttggtttacgctaaaagctttgccgatgtatatgtgggagaaccactggtatatgtgaacagcctggactgcatggcagtggcgattaaccaggggaatttctcaagggcatataatattggaacaggaacaaactggagaattacaataagaaaggctccccggataatttacgatgactgatattccggcttgacaattaaaaatgcatagattatactgaaaccagcttgttcaacaagctggtttttgacaaggacaagcagaacgaatcttcacaatcacgtgaatatttgctctgcatttttttttaataaaatcagcgaagatgttttcaacctctgcaggcgtcagagaaaccgccaaaacaaggttgacggcagtgcagctgccggtccattctgtgtttgtatgtgaatgcaggatgaggattgaaatagatcatgtcaaaggaggggcactttatggtgaaagaatgcgggtcgcaggaccgccctgccttgcttgcctatctgaagcaggagcctgtctacaatacgtttatgctggcagatatagtggactttgggtttgacgaaaaatttcagacagtttatatggatattgaggaggaagagtgccagggagtttatctttgtttttaccagaaccttctcctttacagcaagaatgggaatattaatatttcctttttaaaacagctgctttcggagtacataccggatgtggtcatgggaaagataaaggatgtaaaagcggtgcagcggattttgtccgatcacaggctggaagcaagagggctgtatttactctgtgatccaggcagcctgatggaggaaaataccggaatccagcaggcttcaggggaagatgtggatgatatatttgcatttctccagagcattcctgagatgagaagcctttatgcatcaaagcagatgattgaagaccggattcgcaggaactgcggaatccattacctgatccgggaaaacggaaggatcattgcccatgcaaacagtactgcagaatgcgaggagaccactatgatcggcggggtggcagtggagtctgcggcaagagggaagaagctggcgagccaggtggtgagcgcactgtgcaggcaaatacttgctaagggcaagcttccctgtctgttttgcagcaggggagaggagcataacctttattaccggatcggattcagatacatgggagaatgggcgacactgacggcagaagaaaattcaggggcaaggggcaggctcccctcctatattcctgcctataaccagatatacagcgatatcgtgtccggggtttacgaaaaaggaagcaggcttccctcagagacggtgctttcggaaaaataccgcatcagccgcaacacactgaggcaggcccttgcaatcctgactcaggatggttatatccataagcatcagggaaagggcacatatgtgtcctatgataaggaaaagaggcgtaaaaggaagatttataatttcctttcagaagacgcattggaggatatcgttcatatcaccatggattataatttcgggcctcccacccggattgcccgtgaaaaactggggctttccgaagctgaggatgtattggcaagcaataatgtatatgaaagtgaaaacggccccataggccagagtttcctgcaaataccggtagatatattgactaaatggcagatagaccttgattcggaagaagcattgcttgagttcatggatcaggatatttatagaaaggcagaaaatgcccaggtgaacatccaggtgatcgaggcagacgaacaggtgattccctatctgggagtaaagccgaaagctccgcttctccatattgagcaattgctgtatgatgaaggaaaccgggccattggcagaatcaaatattatttccgtttgggaaaatatcagatacaatgccgactataaaggagggggagtctatgagtcagacagagaaaacgccggttatagaatttgagcactttcagtttcaatatttcagccaggcagagcctacacttcatgatattaatttaaaaatatatgaaggagaaaaggtcctgatagtcggttccagcggcagcgggaaaagtacgattggaaactgcttaaatggtctgatcccattttcttataaaggagagatacaggggagtctgaaaatcagcggaaaagacacacgggaaatgaatatttttgagttgtccaaaagggtagggactgtgctgcaggatgcggacggtcagtttatcggtctgacagtgggggaagacattgcatttgccctggaaaatgactgtgttcccctttcgcaaatgaaggaaacggtccagaaggcagctgacattgtggacatgggaaagctgctgaaatcctctccctttgaattgtccgggggacagaagcagagagtttcgtttgccggagtgatggtagacaacgtggacattctgctgtttgatgagcctcttgccaatctggatcctgctacgggaaaaacagccattgatttgattgaccgggtatggaaggaatcgaagaaaaccgttattatcatagagcaccggctggaagacgtgctttaccgggaaatagaccgcatgattgtagtcaatgaaggccggattgtggcggatatgactcctgatgagctgatggcggcccacattcttccaaagcttggaatccgggaacccctttatgtcactgcaatgaaatatgcagacattaaagtgactccccagatgcgcgccggacgcatccataccctggatatctcccaggtgaaggagcctttgcagaagtggaaccgggaacaaagggaggtgcctggtgaaaaggagcgccggatcatactggaagcgaaacatttaagcttccagtatacaaggaagcggaaaattctgcaggatatcaattttaagatccgggagggcgagatggtcagcattgttgggaccaatggtgccggaaaaagcacccttgcaaaggttatctgcggatttgtcacagaggatgaaggaaggctcctgtactgcggagaggatttgaaaggccagaccattaaggaacgctcacagaaaataggatttgtaatgcaaaatcccaatcagatgatctgcaagcccatgatttatgatgaggtggccttagggttgcgtatccgcaaggtcccggaggaggaaatagagcagagggtacataaagcgctgaaaatatgtggtcttgccccgtttaagaaatggccggtgtctgccttgagctttggacagaaaaagcgtgtgacaattgcatccatgctggtgctggagcctcagatactgattttagatgagccgacagcaggacaggattaccgccattatacggaaattatggaatttttaaagagcttaaaccagctgggagtgaccatcctgctgatcacccatgatatgcatttgatgctggaatacactccccatgctattgtgctttcccagggaaagaaaatcggagatgccagtgcggcttacattcttacggatgaagatattgccgcccgggccaatctaaagatcacatccttatatgatctggcgataaaggctgaaattccggacccgactgcgtttgtgcagaatttcatcaattatgaaaggggggcgcaccgttcatgaaggcaaagctgtttgactatattgacagggataatttcatttataatctgtcaggactgacaaaattgatctgttttatctgtatgacgttttccgttatgttttcctacgacatcaggtacatcctgtttgttatggtgctgtctgtgatttttttcagactgtcccaattgcagtttaagcagatcaaggtgatgaccatctatgtggccgtttttttactgataaattttattttgacctatttattcagcccccagcatggcacccagatctacggaacaagccatgagttgttccggttcagcaggcgttatacggtgacatcggaacaattgctctatcaggtgacaaagactgtaaaatacgcatcagtagtgcctttgggaatgatttttctgctgaccaccaatcccagtgagtttgcagcttccataaaccgggcgggctgtaattacaaaggggcatatgcactttccctgacactcaggtattttcctgatatgatccgggattaccaggatattgccctggcacagcagagcagaggattggatatgtccggcaaggaaaagctgggcacccgcataaaaaatgtgatgaatatctgcgttcccctgatattttccacattggacaggattgagttaatcagtaatgcaatggatttgagaggcttcggaaagcataagaaaaggacctggtatgtggcaaagcccctgggaaagggagactggggtgcgattgtctttggcatacttatcctggcaggatcactgtccatgacattctttgtaaatgcttccagattttataatccatttgtataatcccggcagtgaaggggctgggttcccatatgaatgcagaagacggacaaaaatggcctgtagaaaaaatataaaataagagaaaggaatcaatgatcatgaaaccaattttagtatttcagacagactttacttataaggagggcgctgtcagctccatgtacggagttgtaaaatgtgtggacagggagctggaaatcatggacggaacccatgaacttccccagtatgatacatggagcgccagctaccgcttataccagagcctgcagttctggcctgagggaaccatctatgtatccgttgtggatcccggagtgggaaccggcagacgtccctgcgtggcaaaaacggtggatggctattatattgtatcaccggacaatggctccctgactcatgtgaagagaaagatcgggattgaatcggtgcgtgaaatagatgaatccgtcaacaggctgcgtggaaaaggaacagagggtgttgctattttccatgggagagatttatttggctatacagcagcgcgcctggccagcggaatcattgattttgaaggggtgggtccggaatacccggtagaggaaatcgtggagcatcctattttagagccaacagtaacgcctggtaaggtggaaggaatttttgaaatcaatgatcccaacttcggaaacctgtggacaaacattcccttaaaggattttaaagaagctggatttgagtatggagattttgtgaaccttgtgataaaatataaagataagattgtatttgaacagaaagtgctgttccatcagagctttggatttgccaaaaagggggatcccatgatttacaacaatgaattgatgaaggtggcggttgctgtcagtcagggggatttttgcagtgaataccatctgggatacggagcggagtggacagtagaatttacaaaataaccctataacagtgatctcattggaggaagagctatggaaaagaagatgtttgagttcaagactaaaacaattgttgccaccgggcttggcgcggccttgttcacgttactgtttatgtatgtgaaggttcccacaggaatcccggaaacagatattcagactgcctatggaatcggcgcgtttttcgctgctctgttcggacccattgcaggaggcctgattgcatttatcgggcacgcattgtcggattccattcagtatggctccgcatggtggagctgggtgatcgccagcggcgtatcctgctttcttattgggctggtttatcccaaaatgagggtggaagagggagaatttgaagtaaaggatgggattcgcttcaacatttatcagcttgctgcaaatgtgattgcatgggtggttgtggctcctgtgctggatattgtgatttatgcagagcctgtgaacctggtatttacccaaggcattgtggcagccattacaaacactgcctcagctgggattatcggaacaatcctgctggtactctacagtaagacacggtcaaaaaagggcagcctttctaaagaaggataacagggaaagatgagaacgttttacatggacaggatctgcctgacagcagatcctgtccatttataaaattatccgtttttttgaaaaaagtgcttgcaatgtaaaaaaaaatatgatatcatacaaaggctgtggcatgatagctgtgaaacgtgaggttgctgcttatataagcaggttttccgtggagcgaatgtcaagttaggaaactggcgacaagtcactgtacaatttaaaattctgttttatgaaacaggaagtcagtgtgtgatcctgaaggacacacacgggaacgtgtacagtcaccgcttgtcgtacttctactaagtgcgaaaaggaggcgactttttttatggcaagtcaagtaatgagaatcacattaaaggcgtacgatcatcagttagttgatcagtctgcaggcaaaatcatcgacactgtaaaaaagacaggatctaaagtgagcggcccggtgccgttaccaaccaagaaggaagtggtgaccatcttaagggcggttcacaagtacaaagattccagagagcagttcgagcagagaacgcataagagactcattgatatcattacaccaagccagaaaactgttgatgcattatccagactggaaatgccggcaggtgtgtacatcgatatcaagatgaagaataaataatcttcatcagaagcattgtggaaaatattccatgcatgtcctgaagggttttaatatagaagcaacacttttcctgtaaggaatcaacatctccataatcggacttcagtcatgatgccgccgaatggagtcatagtgttccacgtatattggactgttctaggatgattgcgaaagcaatccgctgtagaattaacaaacaggaggtaaaaacatgaagaagggtattttagctaccaaagtcggaatgacacagatcttcaatgaaaacggagtattaactccagtaacagttcttcaggctggtccttgtgtaataacacaggttaagaccgtagagaacgatggttacagtgcagtacaggttggttacgttgataagagagaaaagcttgtcagcaagccaataaagggccattttgataaggccggtgtatcttacaagagatacgtaagagagtttaagcttgagaatgctgaccagtattctgtaaaagatgaaatcaaagctgaaatcttcgcagcaggcgataagatcgacgcaaccgcaatctccaaaggtaaaggtttccagggtgctattaagagacacggacagtccagaggacctatggctcacggttccaagttccatcgtcatgcaggttccaacggtgcatgttctgatccgagcaaggtattcaagggcaaaaagatgcctggccagatgggtaataagaaggtaacaatccagaaccttgaaatcgttagggttgatgcagaaaacaacctgattctggttaagggtgctgtaccaggacctaagaagtctttagtaacaatcaaggaaacagtaaaagcatctaactaatgcttttataagaaaggaggatcacacagatggcaaacgtatctgtttacaatatggaaggtaaagaagttggcacattagagttaaacgatgctgtgttcggtgtagatgtaaatgagcatctcgtacacatggcagtcgtaagccagcttgcaaataagcgccagggcacacagaaagcaaaaacacgtgcagaagtatctggcggcggaagaaaaccgtggaagcagaaaggaaccggtcatgcaagacagggttcaacaagatctccccagtggacaggcggtggagttgtttttgctccaacaccaagagattacacaatcagactcaacaagaaggaaagaagacttgctcttaagtccgctcttacaagcagagtgaatgataacaagttcatcgttgttgatgagttaaagtttgatgagatcaagacaaagaagttccagactgttttaaataacttaaaggtatccaaggcacttgttgttatgggtgaggacagcacaaacgcagtactgagtgcaagaaacgtcgctgctgttaagactgcttttgctaacaccatcaacgtgtacgatatcttaaagtacaacacagttgttgctaccaagactgctgttgcagcaatcgaggaggtgtacgcataatggcagatattaagtattacgacgtaatccagaagcctgtagtaactgagaagagcatgaacgctatggcgtccaagaagtacacatttttagtgcacacagatgctaataaggctatgatcaaagaagctgttgagaagatgttcccaggtgctaaggttgccagcgtgaacaccatgaacttagaaggaaagaccaaaagaagaggaacgacttttggaaagacctctaaggcaaagaaagctattgttcagctgacagctgacagcaaagacatcgaaatcttcgaaggactgtaagatcggaacgcttggcgggaatttattcaagcccggcgtaaacggtttttcagttttctatgtgatgaacattatatcacgataattgagatacgccaggcggcgttgaagtacttctgattctttgtgtttcaagagcatggacgaatagagaagaaacgcccacggcatacctttatgcccgggaaatacgggcaataaagaagaaaggagaaatatcatgggaattaaaaagtataacccatataccccttccagaagacacatgaccggttctgatttcagcgaaatcacaaagtcagctcctgagaagtccttaatcagcaaaacgatcaataagacagccggccgtaataaccagggtaagatcacggtaagacatcgcggaggcggcgttaagagaaaatatagaatcattgactttaagagaaacagcaaagacggcattgcagcaactgttatcggtatcgagtacgatccaaacagaactgccaacatcgcgctgatctgctacgaagacggtacaaaggcttatatccttgctccggctggtttaacagatggcatgaaggttatgagcggtgcgacagcagaagcaaaagtcggcaactgtttaccattaagccagatcccggttggtgctcaggttcataacattgagctttatcctggaaaaggcggacagttagttcgttccgcaggaaatgctgctcagttaatggcaaaggaaggcaaatatgctactcttcgtttaccctccggcgagatgagaatggttccgatcaactgcagagccaccatcggtgttgtaggcaacggtgatcacaacctgatcaatatcggtaaagccggcagaaagcgtcacatgggcttccgtccaacagtacgcggttccgtaatgaaccccaatgaccatccacacggcggtggtgaaggcaagaccggtatcggacgcccaggcccaagtactccatggggcaaaccagcgctcggcttaaagaccagaaagaaaaacaaacactctaacaggctgatcgtcagaagaagagatggaaagaccgttaaataattgaaggaggttagaacctatggctcgctcacttaaaaaaggaccatttgcagatgctcatttactgaaaaaagtagatgtaatgaacgcagcaggacagaagcaggtaattaagacctggtcccgccgttctacaatcttcccgcagatggttggacatacaattgcagttcatgatggcagaaagcacgttccggtatatgttacagaagatatggttggacataagctgggtgaattcgttgccacaagaacctacagaggacatggcaaagacgagaaaaagtcaggccgtaagtagtagagaaacaaacacctttgggcattcttacggattcccgggggcgttaaagttgaaaggaggattcaccaatggctaagggacatagaagccagattaagagagaaagaaatgctgtgaaggacaccagaccatcagcaaagttatcctatgctagggtttctgttcagaaagcatgcttcgtattagacgccatcagaggcaaggatattatgacagcacttggtattgtaacttacaatcccagatatgcttctactttaatagagaagttattaaattcagcagttgctaacgctgagaataacaacggtatggaccctgcaaaactttacgtagaggaatgctttgcaaacaagggaccgacaatgaagagagtaaaaccgagagcacagggccgcgcttacaggatcgaaaagagaatgagccatatcaccatcgtgcttaatgaaagataaggaggcaaataatgggacagaaagttaatccacacggcttaagagtcggtgttattaaagactggaactcaaaatggtatgctgaagctgatttcgcagataacctggtagaagattatgcgatcagaaagtttcttaagaagagattatacagcgccggcatttctgatatcgaaattgaaagagcatctgaccgcgtgaaggttacaatccacacagcgaaaccaggtgttgttatcggcaagggcggatctgagattgaaaaattaaaagttgaagttcagaagcttacagataagaagttatttgttgatatcaaggaaattaaaagacctgacaaagatgctcagttagtagctgaatccattgcacagcagttagagaaccgtgtatccttccgccgggcgatgaagtccaccatgggacgttccatgaagtctggcataaagggcatcaagactgcagttgcaggacgtcttggcggcgctgatatggctcgtacagagttctacagcgaaggaaccattccgttacagacactcagagcagatattgactatggtttcgctgaagcagatacaaccttcggtaagatcggtgttaaggtatggatctacaatggcgaaatacttccaactaaaggaaacaaggaagggagcgataaataatgttaatgcctaaaagagttaaacgtcgtaaacagttccgtggatccatggctggtaaagcgttaagaggcaataccatcagcaacggcgagtttggtttagtttccacagaaccatgctggattaaatcgaaccagatcgaggcagcccgtgttgctatgacccgttatatcaagcgtggcggtaaagtctggatcaagattttcccggataaacctgtaacagcaaagccagcagaaacccgtatgggttccggtaagggcgctctggaatactgggtagcagtagtaaaaccaggccgtgtattattcgaaatcgctggagtacctgaagaaacagcacgtgaagctttacgtcttgctatgcataagttaccgtgcaagtgtaagattgctgctaaagcagatttagaaggcggtgaatgacagtgaaaattgataagtatgttgaagaattaaaaggaaaatccgttgcagagctgcatgtagaattagtagctgcaaagaaagaacttttcaacttaagattccagaatgcaaccaaccagcttgacaacacaagcaggatcaaagaggttcgcaagaacattgccagaattcagactgttataactgagaaggctaaattagcttaagttgcagtttttttaaaaaagcacgacacacacgagcgtgtgtaaacttatagattgggccgccagggccaaaactcgaaaggagaataccgaacgtggaaagaaatttaagaaaaacccgtactggtaaggttgtgagcagcaagatggataagactatcgttgtagcgattgaagaccatgtagaacatcctttatacggcaagatcgtaaaaagaacgtataaattaaaagcccatgatgagaaaaacgaatgcaatatgggcgatacagtgaaagtaatggaaacaagaccgctgtcaaaagacaagagatggagacttgttgagattatcggaagagcgaaataatttatttccaggaaggagtaacaggtatgattcagcaggaaaccagattaagggttgccgacaataccggtgcaaaagagatcctttgtatccgtgttatgggcggctctacaagaagatatgctaatattggtgatgttatcgttgccagcgtaaaagatgcaacgcctggtggtgttgttaaaaagggcgacgttgtaaaggccgtagttgtacgcaccgttaagggtgcacgccgcaaagacggttcctatatcaagttcgatgagaatgctgccgtaattatcaaagatgacaagactccaaaaggaactcgtatctttggaccggttgccagagagttaagagagaaacagttcatgaagattgtttccttagctccagaagtattataaggaggtgtcggactgtgcataaaattaaaagagatgacctggtaaaggttatcgcaggaaaagataaagacaaacagggcaaagttcttcacatagatacgaagaataacagagtggtagtggaaggcatcaacatgatcacaaagcatgtaaagccaggcccaggcagcccacagggtggtatcatacagaaagaagctgcacttgatatctccaacgtaatgcttgttgttgacggaaaagcgaccagagttggttttgaagtaaaagacggcaaaaaagtccgtgttgcaaaagcgaccggtaaagtaattgactaattcggagaggaggaataaaaattggctagattaaaagagatataccagacagagatcgtagaagctatgatcaagaaatttggatataagaacgtcatggaagtgccgaagttaaataagattgtcatcaatatgggtattggtgaagcaaaggaaaatgccaagattttagactctgcagtaagagatttagaaatcatctccggtcagaaggcagtcttgacaaaagctaagaaatcaattgcaaacttcaaaatcagagaaggtatgccgattggctgcaaagtaaccttacgcggtcagagaatgtatgaatttgctgatcgtctgatcaaccttgcgcttcctcgtgtacgtgacttcagaggtgtaaatcctaatgcattcgacggcagaggaaactacgctcttggcattaaggaacagcttattttccctgaaattgagtacgataaagttgacaaggtaagaggtatggacgttattttcgttactaccgctaagacagacgaagaagcccgtgaacttttgacattattcaatatgccatttgcaaaatagtaggaggaagaatccatggcaaagacttcaatgaagatcaaacagcagagacctgcaaaattctccacaagagaatacaatcgctgcagaatctgtggtcgtccacatgcttatttaagaaaatacggaatctgcagaatctgcttccgtgaattagcatacaagggccagatcccaggcgttagaaaagcaagctggtaaaataaggaaggaggcaatttcaaaatgactatgagcgatccaatcgcagatatgcttacaagaatccgtaatgcaaatactgcaaaacatgatacagtagatgtaccttcatctaagatgaaattagctattgctgatatccttgtaaaagagggatacattaaaaaatatgatgtcgtagaagacggtgcattccagaccatcaggatcaccttaaaatacggtaaagataagaatgagaaaatcattacaggtattaagagaatctccaagccaggtttacgtgtatacgcaaacaaggaagagttacctaaagtacttggcggtttaggaacagctattatctccacaaaccagggcgtaattaccgataaggatgcacgcactataggtatcggcggagaagtactggcatttgtttggtaattaacagaagcatctgaaaacagaaggagcgcaaagttctttccgaaaatttaaggaggtaaacggcatgtcacgtataggaagaatgcctatcgcggttccggcaggcgtaactgttgcaatcgcagaaaataataaagtgactgtaaaaggtcctaagggaactcttgaaagagtgttgccatctgagatgacaatcaaagaagaagatggtcatatcgttgttacaagacctaacgatttaaagaagatgaaatccttgcacggtctgacaagaaccttagtaaacaacatggtcgttggtgttaccaacggttatgagaaaaagcttgaaatcaatggtgttggctacagagcacagaagcagggcaagaaactggttctttctcttggctattcccacccggtagagatggaagatcccgaaggcatcgaatctaccatggaaggacagaacgtcatcattattaaaggtatcgataaagaaaaagttggccagtacgctgctgaaatcagagataagagaagacctgaaccgtataagggcaagggtatcaagtatgctgacgaagtgatcagacgtaaagttggtaagactggtaagaaataattaaggagagtgtaaagatggttagcaaacagtcaagaagcgaagttcgcgttaaaaaacacaacagattacgtaaccgttttgcaggcactgcagaaagaccgcgtttagctgtgtttagaagcaataatcatatgtatgctcaaattattgacgatacagttggtaagactttagtcgctgcttctacagtagaaaaagaagtaaaggcagaattagagaaaactaacgacgttgatgctgcagcatatgtaggtaccgtagtggcaaagagagccattgaaaaaggaatcaaagaagttgtctttgacagaggcggatttatatatcagggtaagattcaggcattagcagacgcagccagagaagctggtctggaattctaagtagagaggagaatgacagcgtgaaacgtacaatttttgaggcaagtcagttagaattaaacgacagagtagttgctatcaagcgcgtatctaaaaccgttaaaggtggacgtaccatgagattctctgctttagtagtcgtaggtgatggcaatggccacgtaggtgctggtcttggcaaagccggtgaagttccagaagcaatccgtaagggaaaagaggctgccgttaagaacatggttgcggttcccattgatgagaacagcagcattcctcatgacctgatcggtaaattcggaagtgcatctgtacttcttaagagagctaacgaaggtacaggagttatcgcaggaggccctgcacgtgcggttttagagcttgcaggtattaagaatattcattctaagtccttaggttccaataataagaccaatgtagttttagctactatcgagggattaacccggttaaaaactcctgaggaagttgcaaagcttcgcggcaaatctgtagaagagattttaggctaaggaggatatgaaaatggcagataaattaaaaatcacattggtgaaatccccgatcggcgcagttccgaagcataaagcaaccgttgaagcattaggcttaaagaagcttcataagacagttgaaatgccggacaataacgcggtcagaggtatgatcgccaacgtgcgtcatttagtaaaagttgaagagatttaagagaatacagtaaggaggtgcaagcgatggatttatcaaatttacagcctgcgttaggttccaaacacagcgacaacttcagaagaggccgcggacatggttcaggaaacggcaagacagcaggtaagggtcataagggacagaaggcacgttccggtgctaccagaccaggttttgaaggcggccagatgcctttatacagacgtattcctaagagaggctttacaaatagaaatactaaaaccattatcggtatcaatgtaaatgcattagaggcattcgaaaacgatacggttgttactgttgaaactttaatagagagcggtattgttaagaatccgcgtgacggtgttaagatccttggaaatggagaattaaccaaaaagcttacagtaaaggtagatgctttcagcgaaggcgcaaaaaccaaaatcgaggctttaggtggaacctgcgaggtgatctaatatgttaaaaacactccgtaatgcattcaagatcaaggacttaagaaagaaactcatctttacgttcctgatgctggtggttaccagaatcggttctcagctgccgattccaggagttgaaacaagctttttcaaagatttttttgctcagcagaacaacgatgcgtttggatttttcaacgccatgactggcagctcttttaccaacatgtccgtgttcgctctgagcattaccccttacatcacatcttccatcatcatgcagcttttgaccattgcgattccaaagcttgaggaaatgcagcgagatggtgaagacggaagaaaaaagattgcagaatacacccgttacgtaacagttggtctggctttgatcgagtccgtcgctatggcggtcggattcggcggccagggtctgttaaaagaatttaatgccttaagcattattatcgctgttgcaaccatgacggcaggaagtgctcttctgatgtggatcggtgagcggattacggaaaagggtgtaggcaatggtatttccatggtcctgtcatttaacatcatttccagctttccgactgatgcgtcaaccttatataccagatttatgtctggaaaatcggttgccgtagcagcagttgcagccattgttatcattgctgttattgtggcaatcgtggtatttgttattatccttcaggatggagagagaaggattccagtacagtattccaaaaagatgcagggacggaagatggtcggcggccaagccaccaatattccgttaaaagtgaatacagccggcgttattccggtgattttcgcttcctccattatgtcgttcccggttgtaatctcccagttctttggggcgagtatcaactacaacagcattggaggccacattttggcggcgctgaactcttccagctggttcaagccggaaagaccggtgtatactatcggcctggccgtttacgtggcacttattattgtgttcgcttacttctatacatcaattacgtttaacccgcttgaagttgcgaataacatgaagaagtccggcggctttatcccgggtatccgcccaggaaagcctaccagcgattacctcaattctattttaaactatatcgtatttataggcgcatgcggcctgacgattatctgtatcgttccgatcatggtgtccggtttattcaatgtaagccgtttatcattcggcggcacatccttgatcatcatcgtcagcgtagtcttagaaacgttaaaggcgattgaatctcagatgcttgtgcgctattataaaggctttttaaacgattagaggacaaaccaagagaaacacgcgcggcgtgtttttcttggaatttgtattattatccttaaagaagttatgtatttcatgtaagggagggactgtctatgaaaattatcatgttaggtgctcctggtgccggcaaaggcacccaggcaaaaaagattgccgaaaggtatcagattccccatatttctaccggagacatttttcgctccaacatcaaggaggggacagagttaggcaggaaggcaaaggaatacatggatcagggtgctcttgtgccggatgaactgaccattgggatgctcatggaccgcattcagaaggaagactgtgtaaacggatacgtactggatggttttcctagaaccattccgcaggctgaaagccttaaaaaggcactttctgagatggggcagaagattgactttgcgattaatgtagacgtaccggatgagaagattatagacagaatggcaggccgccgtgcctgtattgcctgtggagctacatatcacattgtgtataatccaagcagggttcccgatgtatgtgatgtatgcggggcaggtcttgtcctgcgggatgatgataagccggaaactgttaaaagacgtttgtcggtctaccatgatcagacgaaacctctgatcgattattataaggaagcaggtgtactggtgaatatcgatggaacacaggatttaagcaaggtgttctcggacatctctgctgttttaggagcatagtttatgtcagttacgatcaaatctgcaagagagatagaacttatgagagaggcaggaaagattctttgtaaaactcatgaagagctttcaaaagccttgaagccgggaatgacaacctgggatattgatcatctgggagaagaaatcataaggagttatggctgtacgccctctttcctgaattataatggttatcctgcatccatctgcgtttccgtaaacgatgaggtggttcacgggattccaagtaagaagcgtgttttagcagagggcgatatcgtaagtctggatgccggagttatttacaaaggatatcattccgatgcagcaaggacttacgggatcggagagatcactcctttcgcaggacagctcatagaagtgacaagacaatgtttctttgaagggattaaatttgcaaaatctggcaatcatctgaatgatatatctgctgcaatccagaactatgcggaaaagtttggctttggagttgtccgggatctggtaggccatggaatcggctctcatttgcatgaggagccagaggtaccgaactttgcacggaaaagacggggaatcaaattaaagccgggaatgactctggccatcgaacccatgatcaatgggggaacgcctgaggtcgtatggcttgacgacgattggaccgttgtaacagaagatggaaacctttccgcccattacgaaaataccgtactgatcacggagggtgaaccggagatcctttctctggtttcccatgtccgatgaggaagtgtccatgatgttaggcaccggagcatttgtaagatctgtggcaggacacgataaaggcggttatttcttcatattacgggaggaaggggaatatatatatctggtggacggaaaatacagacgtctggactgcccgaagaagaaaaagaaaaagcatgtggaagcccttttatgggagaaacattcccctggaacgaaaatcagggaaaataaatcagtcaccgatgaagagatcaaacatttcatcagatgtttcaaaagagaagaacaggttgttaggaggtaagctttatgtcaaaagcagatgttattgaaattgaaggaaccgttgtggagaagcttcccaatgccatgttccaggtagaactggaaaatggccatcaggtactggctcacatcagcggaaaacttcgcatgaactacattcgtattttaccgggagataaagtgaccattgagatgtccccctatgatttaagcaagggacgtatcatctggagagacaaatagggcgccttttcataaaaggctgcctgtttctcaggcgcgacacgccagggtaaagggttaataaatatataggaaaaagtgcttgcattttaaaataaagagtgttataatgctatagcgactttgttgaaatactgggtgtattatgcccttatgggcagcactggttttacgataaaaacacactgcgggtatactcagaaagctctttgcaagaggagactccatcgccgctgggcttgttgagagacttgtccgagtgtcggaggagcgctttcgcacggaaacgcctataaacggcgcaaagtgcttaatgtgaaagggcgcataacggaaaggagaattgctgtgaaggttagatcatcagtcaaaccgatttgcgaaaaatgcaaaatcatcaagagaaaaggcagtatcagagtaatctgtgaaaatcctaagcataagcagagacaaggttaaaaaaataatggaggtgtaatacacaaatggctcgtatttcaggtgttgatttaccaagagaaaaacgtgttgagatcggcttgacctatatctacggtatcggcagaacaagttcaaaccgcatcctgacagaagctggcgttagtcctgacactcgtgttaaggatttaactgacgacgaagtaaagagaatttcatcagtgattgctgattctcagattgttgaaggtgatttacgcagagaaatcgctatgaacatcaagagacttcaggaaatcggctgctatcgcggaatccgtcataggaagagtctgcctgttcgtggtcagaaaacaaagaccaacgcaagaacacgtaagggtcctagaaagactgtagcaaacaagaagaaataagtaaggataataatatcctcacccaataacagcgaatcacgttacatgttttaaaaacaggaataacaggattcagatgcaagtaaaaagaaagtaggttagtttaaaatggctaaaaaaatgtccactactaaaaaagtgacaaaaaagcgcgtaaagaaaaacgttgaacgcggacaagcacatatccagtcatcttttaataacacgatcgtgacattaacagatacacagggtaatgcattatcctgggcaagtgctggtggtcttggcttcagaggttcaaggaaatctactccatatgcagctcagatggcggcagaaactgctactaaggcagctcttgtacatggtttaaaatcagtagacgtcatggtcaaaggtcctggttcaggccgtgaagcagctattcgtgcacttcaggcatgcggattagaggtaaccagcattaaggatgtaactccggttccacataacggttgtcgtccaccaaaacgtagaagagtctaattaggaggtaattacagtggcagttgacagagttcctgttcttaaaagatgtagatcccttggtcttgatccgatctatttaggaatagataaaaaatcaaacagagaattaaaaagagctaacagaaagatgagtgagtacggcattcagcttagagaaaagcagaaagctaaattcatctacggtgttcttgagaaacctttccgtaactactatgcaaaggcttccagaatgaatggtctggtaggtgaaaacctgatgatccttctggagagaagacttgataatgtagtattccgtatgggattcggaagaacaagaagagagaccagacagatggttgaccataagagcattcttgtaaacggcaagtgcgtaaacattccttcctatttaattaaggctggagatgtgatcgaagtaaaagagaagagcaaagccaacccaagatttaagagtgttcaggaaacaaccgcaggacgtatggttccggcatggcttgatgttgaccatgagaatttacgtggtactgtaaaagagttaccaacaagagatgagattgatgttccggtgaatgaaatgcttatcgtcgagttgtactccaaataattgaaagtctgttgattgaagccggctttcgcccggggggatacccctccgggcaaggtttgagtataagaccctcgatacaaaatacccaaaaggaggggctattagtgttcgattttgaaaaaccaaacattgagattgctgaaatctcagaagataaaaaatatggcaagtttgtagttgaaccgcttgaaagaggttatggcacgactttaggaaattccttaagaagaatcatgctttcttccttaccgggcgctgcagtgagtcaggtaaaaatcgacggcgttttgcatgaattcagttctattccaggtgttaaggaagatgtaactgagatcatcatgaacatcaagagcttatctattaagaataacagcgacaccaacgaagcaaaggttgcttacattgagtttgaaggcgaaggcgttataacggctgcggatattcaggcagatcctgatatcgagatcatgaatccggagcaggtcatcgccaccttaagcggcggcacggacagcaagttctatatggagcttactattaccaagggccgcggctatgtaagcgcagataaaaataagagtgaagatttacccataggcgtgattgccgttgattctatttatacaccagtggaacgcgtcaacatgacggtagaaaacacccgagtaggtcaggttacggattacgataagctgacattagatgtatttacaaatggtacctcggcacccgatgaggcagtcagtcttgccgcaaaggtgttaagcgaacatttgaacctgttcattgatttatctgagaacgctaagactgcagaagtcatggtggaaaaagaagataatgaaaaggaaaaggttctggaaatgaacattgatgaactggagctttctgtccgttcatacaactgtctgaagagagccggtatcaatacggtggaagaactgtgcaaccgtacctccgaagatatgatgaaggttcgtaatctgggccgcaagtctttagaagaagtgctggccaaattaaaagagttaggcttgcagcttaacccaagcgatgattccgctgtataaccggaccgcttgaagcagctgatttatggagataaagcattggtacaataagtccgaagaagcatgtaccagtgttccacaaatggaggaatattaaaatggcaggatatagaaagctgggaaaaacttccagccagagaaaagcattaatcagaagccaggtaactgcattattatataatggcaaaatcgtgacaacagaggctagggcaaaagaaatccgcaaggtggctgaaggcctcatcgctttagcggtaaaagagaaagacaattttgagaatgttaaggttaccgcaaaagttgcacgtaaagataaagacggtaagagagtgaaagaagtcgttaacggcaagaaagttaccgtttacgatgaagtggagaaagagatcaagaaagatcttccttccagacttcacgctagaagactgatgttaaaggttctttatgacgtaacagaggttccggcagaagctgcaggaagaaagaaaaacacaaaatctgttgatctgccaaagaagctgtttgaagaagttgccccaaagtacgtatcccgcaacggcggctacacccgtatcgttaagatcggccagcgtaaaggcgacggagccatggaagtagtactggagttggtataaccacgaaagcaatgagcagtgttgaaaaaaggttcgatagaattttcgttgtgcttgcacataagaaaattctatcgaaccttttttcatagggcgaatgcccgtgggctggggtatccgcaggataccccagcccacactgcggacttattgcagatcccccatatcaaagtacattctccatcatattttttaattcaaaaatccccgccaaaacgcctccattccataaatctccccaaccatcaagcttttatccatttccctcctcccatttaaagaaccgcaagaataaagaaagaatatcgtaagttgacggtcaattggtttcagggatataatgtcagtaatagaagtagatgactgttttgtcagaatacgttaaataggagagtgggaggtttttttatgaaacattttaaacggttagttgctttggcttctatggtgagccttttggggctcagcattccatttgagtccctggctgctgtaaagaccataacatcagtgaccatttacgcagggctggaggaactggaatcgggagagacgctgccatcagaagacagctttaaaatgaatgaagcaacaggaaactatgtttataccaataacgacagatacgaagtgacagaggtggactggatcacatccgatacaaaggagatgaaagtgggatctgaacctaagatgaaggtgactttaagggcaactaattccgatgaatatgcctttaagggaggatatcagtccagtaacattaccattaagggaggaacttatgtttctgccagccgttcagggtcagatacactgtatgtcacatttacctttaaacccataaagggcacatatgaatcaccggaagatgcttactggagagaatcaggatacggcaatgccaaatggagctccgtggataacagctcaggtgcttatgacgtttatttatacagaggaagcagcatagtgaaaaaggttgagaagcttaaggctacctcttacaacttctttccttatatgacaaaggcaggtacttacagctttaaagtgcgtaccgtaccatatacggaaagcgaacagaaatatggaaagaacagtgactggacagaatctgatgaagtatatctgcccgaggaaaaggtatccgatggaagcggccaggataacggcactccaacaagcgggcaggtaggctggatcaaaaacggcaactcctggtattaccgctatcccgatggaacctatcataaaaacaactgggcaaagatcaataataagtggtatttatttgattccaacggtgctatggtgaccggctggcagcagagaaataacttatggtatttcttaaacagcgacggagccatgacatccgggtggatcgtttctaataataaatggtattacttaaatccttccactaccagcggtgtggagggtgccatggcgaccggctggatcaattacaataataaatggtattatacggattcctcaggagttatgcaggaaggctggaagcaggtagacggaaactggtattatttctatccaggtgaggggtcaaaggctgtcaatactaccatcagcggatttccggtagatggcaacggtatatggcgtaagtaacagcaggaaaggaagtagatatcgatgaagtggatgcaggggaaagggaagtggctggtgcttttatgtgccttaatggttctgggaacagggatgacagtcccggcttccggaagcttgaagatccgcctggatcatggaagcaaaagcagctggacggaaggaatccaggttccgtctgtaacggtcaactattcagaggtaggtccggaatggagcaaggagaatgtggatgattgggtccccggaaagaagataaccggtaccataagagtgagcggcacttataccagatctgactgtaccgtttatggaggaagcctggtttctgtaaatgcagaagatgaggaaactgtaataaaggtttcctacgtcccggtggcaatgctggaaagcccggaaagggcaggatggagcgacaacacgaagacaaaggcttcctggaaaaaggttccgtttgcttccaggtatcaggtgatcctgtacaaggagggcggtatctggatcaagagcctgaccacttcatcgacttccgtggatctattacagtacatggatggaggttataagtatttctataccgtaaaggcaattccaaaggattcttctgaggaagattatctgaaagaaggagaagtgaccacctctgatgattctgtggtccaggagctgggagataccacgggaacctgggcagagtatcagaacgggaaaaaataccggggcgaggatggaaactacgttatgggccagtggaaaatggtcagcggaaaatggtattattttaacagtgatggttacgcggccgttggctggcagtatataggtgataaatggtactatatgggcccagatgcccagatgctgaccggctggcagcaagtaaatgaaaaatggtattatttaaatactgacggtgacatggctgttggctggatccagcctcagcctggaaaatggtattatctctatagtgacggcagtatggcagtgaatacaaaggtggaaggtatctaccaggtagacggctcgggactttgggttccgtaatagaaatggcacagatggctgcatctgtgccgttttttatcgtataggaaagttcgtcctatacgataaaaaccctccgggaggatcgcactgcggcggcaggggtggatgtcgccggggcgacccgccgcaggcggagaatcccgcaagcgggattctttcttgttctggaaacgtgcaccctatttcactccaccccattgaaatattaaaaaaaccttatgaaagcagcatgtgaggctgaaaattatcatttatcaagaaaatttctccgatcacccctggaatttacaaaagattcgtgccgatgcttgactgttatgaaatattcaactaaaattatgtggcatatgaatgtttgaatctatcagagaaaggtccgctatgggaataataaaaacgtcaaaactgatatttgattatatcagaagagatgaagaagaaaatattgaagaaattaagcgtgccattgacggcgtcagcctggatattgaagccgggaagtttgtggccatacttggacacaacggctccggaaagtccacttttgcaaaacagctggatgcgattttgctacctacggaagggactgtgtggattcaggggatggatacctccgtggaagaaaatttatgggaagttcggaaaaagaccgggatggtattccagaacccggataatcagatcatcggaaacattgtggaggaagatgtgggttttggtcctgaaaacctgggcgttcccacggatgagatatggaagagggtagatgaaagtctggagagtgttggaatggctgcattccggatgaagtcccccaataagctttctggaggccaaaagcaaagggtcgccattgcaggtgttatggctatgcgccctcagtgcattgttttagacgagcctacggccatgctggatcctaacggccggaaggaagttgtaaaaacggtcagggaattgaatcgtaaagaagggatcacagtccttctgatcacccactatatggaagaggtcatagacgcagacagggtcattgtcatggacaatggcaggatcgttatggatggcactccaaaggaaatcttctcaagggtagaagaactgaaatcctaccgtctggatgttcctcaggtaacggagctggcttatgagcttcaaaagaatggcatagacttacctgctgggatactgacactggaggagctgatggaaaatcttctgccaaagtttgcagagcgttttccaggatcagtgactctggagaatggagtaaaggatggcaattaaagcagagcatttgaactatgtttacagccttggaacagcctttgagcagcaggcgttaaaggatataaacctggaaataaaagacggggaatttgtgggcctgatcgggcatacaggctctgggaagtcgaccctgatccagcatttaaacggattgatgaaagccacttcaggggccatttattataatggaaggaacatttatgagggaggttacgatctgcgggctttgagaagcaaggtgggacttgtattccagtatcccgagcatcagctttttgagatcaatgtgtttacggacgtttgttttgggccaaagaatcaggggctttccaaacaggaaaccgagaatcgggcaaaggaagcattgaccatggtagggcttgatgaaagcttttacagccggtcgccttttgagctttcgggaggacagaagcggcgggtagccatagcaggcgttcttgcaatgaatcctgaggtgctcatactggatgagccgaccgcaggcttagacccaagaggaagagatgagatcctggatcagattcataggcttcaccgggaaaggaatatgaccattattctggtttctcacagcatggaggacattgcccggtatgtggaccggattctggttatgaatcatggggaaaaggtgtttgacgatacacccaaggaggtattcaagcattataaggagctggaagccatgggccttgcagcgccccagatcacctatgtggtccattccctgcgggatcatggcgtccccattgatgataacattacaactgtagaggaagccagagacgagattttgcggcttctggaaaaatagatggggagatattatgctgaaagatattactttagggcagtattatccggtggattccagacttcacaggctggatccacggacaaagctgtttgggactatggttttcatcatatccctttttattgcaaatgacatatgggcgtatctgatcgccaccctttttctgattatggcgatccggttgagcgaagtcccatttaagttcatggtgagaggattaaaggcgatcgtatttctgcttcttatcagcgtcagctttaatttgttcctgactccgggggagccgatcatcaggctgggatttttgaaaataacaaaggaaggcgttaaaatagcggcatttatgggagtccggctcatttacctggtgatcggatcttccatcatgactcttaccaccacgccaaaccagctgactgatggcctggaaaaaagcctgggatttttaaagaaggtgggagttcctgtccatgaggtatccatgatgatgtccattgccttaaggttcatccccatccttgtggaagaaacagataagatcatgaaggctcagatggccaggggagctgattttgaaacaggaaatctgatccagaaggcaaagaacatgatcccccttctggttccattgtttatttccgctttccgccgcgccacggatctggcgatggccatggaggccagatgctaccggggaggagaaggaaggactaaaatgaagcccctccggtatggaaaacaggacggagtcgcctatctggtgtatctggtatatctggccgctatcgtaggaattggaatcatgggataagacttcctatgaaaaaggaggatatatgaaacgggttaagatgattgttgcctatgacggcaccaattactgcggctggcagatccagaataacgggatcaccattgaggaagtacttaataaagaactgacttgtcttttaaaggagcctgttaccgtgatcggtgccagcaggactgattccggggttcattctgagggaaatgtggcagtctttaatacggagaatcggatgcctgccgataaaatatgctttgccttaaaccagaggctgccggatgatatccggattctgcagtctgaggaggtagcgccggattatcatccaagaaagcagaactgtgttaaaacatatgaatataaaatcatgaaccggaaaatcgaagtgcctaccatgaggctgtacagctatttctgctattttcccctggatgtggaacggatgcgggaaggcggtgcgtatctggtgggagagcatgactttaaaagcttctgtacggcccggggacaggcagaagaaacggtgcgtaccatttacagcctggacattgaaaaggccggggatctcattacgatccgcattaagggaagcggttttttgtataacatggtgcggatcattgccggaacattgatgaaggtgggaatgggagtgtatccgccgtcttatgtagaagagatcttagatgccagggaccggaaaacagcagggccaaaggcggctgccaagggacttactctggtaagccttgattatgaaacagaacttaagaaacagatcaggggagaaaataaggaatggagttatactcttttccaggatcagatcatttcggaaggaaaggcctggcttaatatccacaggtgccgggaggaagattttgaaagacttttgatccgggtggtccatcaggcggtacaaaacggcgccaggaccatttttgtgagagatgaggagaaggctggaaggatcattttggagaaagcttacggattttatacttttcaggctgattctgagaacaagggctggtatatgacgcaaaaataagccgaaaaatcttgattgatgcgagcaggaagtcaagcaatcgtgattgcaggttcatttggtgattaaggaagcgacaagaagggcctgcaaagcgagtttcttcatatattatgggaaaagaggttgacacatccggctgaatgtaatataatgtataactgtgacgttagacgaaaatgttcagccaaagccccggagtgagcattttgtaatatagttatgcttataaaaaccataatttacaggaggttgtccaatgaagacttttatggctagtccagcaacaattgaaagaaaatggtacgtagttgatgctacaggatatacattaggacgtttggcttcagaagtagctaaggtattaagaggtaagaataaaccgatctacacaccgcatatggattgcggcgattatgtgatcgttgtaaacgcaaataagattaccgtaaccggtaagaaattagatcagaagatttactataaccactctgactatgtaggtggtatgaaagaaacaactttaagagaaatgatggctaagaagcctgaaaaagtcattgaactggctgttaaaggtatgcttccaaagggacctttaggtagaagcatgataacaaaacttcacgtatacgcaggtgcagaacatgacaatgctgctcagaaaccagaagttttagagttcaaattttaatcagaggcgctgaaaggaggaagttatcatggctaatgcaaaattttatggaacaggtagaagaaaaaaatctatcgctagagtatatttagtaccaggcactggtaagattaccatcaataagagagatattgaccagtatttaggtcttgaaacattaaagcttgttgtacgtcagccgttagttgctacagagacagttgataagtttgacattcttgtaaacgttcacggaggcggattcaccggacaggccggtgcaatcagacacggcatctcaagagctttgcttcaggcagacgcggactatcgtccggttcttaagaaagcaggtttcttaacaagagatccaagaatgaaagaaagaaagaagtacggcttaaagtcagctcgtcgtgctccgcagttctcaaagagataagcacacagaaaatcgaatatcaccagaaccccgaaaaacattatgttttcggggtttttttatatgatgaaacaacaagaaacgcttgtaaatagtatcaaaattcagaggtaactgacatgtaactaacaggtaacttacaaataaaaagatatacgaaatagaaaaattatcgattgtaaggaaaggaatccatatgatagaatatgcacaaggacaatcgtgttgcagggtgtgttgacctcattctaagagaatggggtgatgcctatgaaaaatcgttttgattttaaggatattatgacctttggtcttttccttttggcattacttacattcgttttttcgttttgtaagtagctgtacatagcaaaaccaccctataaactttggacggttaagggtggctttgcttctcatataatcagcactctaagttcttcaagcgatagtttttgcctgtttcataagggtaaaagtaatgtaagttcaacagtttccgacttatatttacatgggtatatttggatggaaatatacaggctgcttacaggttgcttacagagaatcagccccggtattaaggcggggaaccatatggaaaaaaagtgaaccggatataaatccctatgcaggggcggacagtttaggctgtccgcctctttttctgcctgcggggcgggaccggtattggccgctgtgacagaaggggcaagcccagcgctgttttgccggtaattggcaagtgctgtttatcattgtaaaatcgtcggaattatggtattataaaacggttagacaaaactaaccaggcttgccgtcatgctgtttaaacaattgctgagagaaagcggcagataaccatatgatccataatgttatgatgccgaaagggtaaagccgtcatgaaaaccaataccacgtgggaattttgcgggcacatggcccgtgacgcaggaggtggaacattaaatgaagataaacattaataatcttgcagattattacgcagggacagatataacctttgcggctgctggtcaatatcacatccagccaggccggtctattgtcaacgcccagacttcaccggagttttgcggattggtcattccccttgagggaagcgcctgctttacattaagcggcgtaccctatatcatgacgcccggcatggtgattcatgcgggtccaggtgtgcaattggataaaaaagtaatcggaaatacgacatggcgatatgcgctgcttcattatcaggtcccccagcacgtgcattcttcatcaccttttttttcttctgactttaatatcccagtcgggatgaatccccgtttgtttgacatggtaagccagctggttaccagctcagtcacgccggggagtgcggcagctctgcgaagccgttccctgtttcacaatctgattgaggaaattgttgtgtcggccttcaggcagcattgtgataactgtggcagcttaattgaggatgcggtcgcttttatgcatgaaaactattccaggcagttttccataacagagctggcggcgcagtacggcatggatgggaaacggtttgcagagctgttccaaagacatatgggaatggcacccatccggtatttaacagcccttcggatcgagcgttccaaagagcttctgagaataagcgactgccctgttatacaggtggcggagtacgcaggatatataaattcctattatttcagcagaatatttaagaaaattactgggattacacctacggatttccgggcagaagcaaaagcgggaaaagtatagctttaagcggaaaaaagtgtatttacttgtttaccatgttttgatacacttactggtgttgagttagacaaaactaactaatatttatattggaggaaggaatcatgaaaagactactggggctgtttttgacagccgcacttttaaccggattggtggcgggctgtgccggaacacctgtggataacagcggaacaagcacgccggaaacaggaaatacggaagcggcagcgtggccgagaacatatgttgatgccagcggaacggaagtggtcttagaggcaaaaccgcagaaaatcgctttgctgttcttccatcattacgaagcggtattggcactgaatgcaccgctttatgccgcgacagatctggaagtatacaatggctgggagtcacttaaaccgtatttggaaaaaacagaacttattgatctgggcggtaccagggaacctaacctggaaaaactcgtggagattgaacccgacctgatcatctcagcagccggggtgcatgacgagatattagacagccttaggaaaattgcgccgaccgttgttgtcagcagaaaagataactttggcacctggcaggggacacttcgtgaatatggcaggatattgggcgaagaagcattggccgaggaacggatcacagacttggaagccatgatttcagaagcgcgcatgacattgagcgctcattcagataaaacggtggctttgatccggcccttagagaaagatgttaattactggatgcccgactatgtatatagcccggaaggtggcttgggcataactagcgccctttcaaagccggatagcgtgtcagcaggtgcagtcacctcctatgaagggtttgccgaagccgaccctgactatatctttttctatgaagatgcactgaatgaggatgatgaagccatacgaaagagcttggaagaaaatgcgttatggggatccctaagtgccgttaagctgggacatgtgtatattctggatcgttcggctttctccggaggaccgctggcaatggaacttggtgtgaaaacaatcctgaacgccatggcaccttcagaataaaccaaaccaacaggacagaacgaaaattcggcacagatctattccaagtaatttctggagaaatcatgcttgaaaaccgggcacagcctgttcgatggcctgcgcccggctttttgtattgcctgaatttttatattaccacggaaaggaggggcgaaactgattgtgatgaagaacttaagacgcttcctgtgctattaccgcccctataaaagactgttttttctggatctgttctgcgcggcggcagcagctctgctgggactgctttttccgtttacagtgagccgtattgtagataccctcctgcccaccggggactggaacctcatttcatctgcctgcgctgcgctggcgggcatctatcttgtcaacactgttctaaaatacatcgtgggttattggggagagcgtttggggctatatatcgaaaccgacctgcgaaccgagctatatatacatatgcaaaagctctccttccgattttttgataaccacaaaaccggccagcttgcgtcccgtatttccaacgacctgctggacgtggggaacatggctcactatgggcctgagcatcttctgatctcggttttcaccctgattggctccatgttcctgatgttttgcgctaactggcagcttgcccttttgatgagcatctttgtcgtggtgctgcttgcaatcaacatgtattttatgaagaagctcgtggaggccaggaaacgcatgtttggggccatcggcggctttatgtcccggttagaggacggaatcgggggcatccgggtggtgcaggcttttgccaacgagccttatcagcaaaagctgttcagaaaggacaatgagaaattctgtgaggcaaaaattgagggcttcaagcataccgcgaagaatgaggcagtaacatatgtattcctcagcctgcttccggtgcttgccctgctgggcggcagctacctttctttaaatggcggcatgagcagcggtgagctgtttggtttcatactgcttggaaatgtaatgatgatgccaatccagatgctggccgctttttctgtccggtttcccaacggtatggctggatttaaaaactttgctgaaatcatggacaccgaaccggagatcaaggacaccccggacgctgatgaagtatgttttctgcgcggggatatcgaatacgaagacgtcacctttggctacaacaaagaccaaaccgtactggagaacataaacctttccgtcaaagctggagaaactgtcgcctttgtgggcgcttccggtgcgggaaagaccacgctttgcagcctgcttccccggttctatgaagcggactccgggcgcatcaccattgatggaacagatattaagaaaatcacgcttcagtctctgcggcggcagattggtgtggtgcagcaggatgtgtttttgttcgcggggaccatccgggagaacattcagtacggcaagctggacgccacggagcaggaaatatgggaggcggtacggtgcgcccagctcgacgaatttatccgggagcagccagatggtctggataccctcatcggagaacggggcgtaaagctttctggcggacaaaagcagcggctgtccatcgcccggatgttcctaaaaaacccgcccatcctcattctggacgaagcgacttcctctctggacacagaaaccgaggcggcaatacagaaatccctcgccaagcttacaaaagggcggacaaccctgattattgcccatcggctggcgaccgtgcgcagcgccgaccggattttggtgatgacggaggagggcattgccgagcagggagggcatcagaagctgctgcaacaaggtggcatatacagccgtctgcaccggacgcagtccgaggcatagcggcaaggaggtaaacaccctaatgaatcaaagaaataaaccggcatcgccggtccagataaatccacagaaaaagaagagccgtgtatgggcggcgtggctcattatcgtatgcggcggcgtggcacttatactgctcatggcgttttccgtcaccaaaggcgcggcacagattccgctatccacggtatgggatgccttgttccgctttgacagggaaagcacccatcacctcatcgtaattgacctgcgcctgccccgtgtaattgccagcgctcttgtgggggcggctttcgcggtagctggcgccatcatgcagggaacaacccgtaaccccatggcggattccgggcttttgggcatcaacgccggagcaggctttgccctttccatctgcttcgcctttttccccggcatgggatacatgcaaatgatcctgttctcttttttaggcgcagcattgggcgcagggttggtaaacggcattgcctctatgcaccggagtgaagcgacacccatgcgtcttgtgctggcaggcgcggcggtcagtgcgctgctggcagctctcggtcaaggcattgccctgtatttcgatgttgcccaggacatcatgttctggacagtaggcggcgtggctggttccaattgggagcagattaaaattatgacgccgtggatactggcagccctgctgtgcgcggtcgctttgtcccattccatatctcttctcagcttgggtgaggatgtggcaaagggtcttgggttgaatgccgccgccgttaacgttctttgcaccctgaccgttctcatactggccggagcctcagtttctgtcgtgggtgcggtgggctttgtcggcctcatcatcccccatctggcgagatatcttgtgggcgtggattaccgctggattatcccatcctcggctgtattgggcgctttgcttatggtggcggcagatttgggtgcgaggatgattaacccgccctttgaaactcccatcggcgtattgaccgcgctggtgggcgtacccttcttcctttacttatcccgcaaacaaaggagggcgctgtaatgaacaaacaacaaatgacaatacaacagaaaaacgaagcgtataagcgaaagatcaccatccgcaacacggccattgttttcggctgtgcggccttgcttgtgatttccttcatcatcagcatgaatacgggctacactaagcttactcccatggataccctgcgtactttattcggcggcggtaccgccaaggaaatcttgatcttgtttgatttccgtctgccccgcatcgtcatttccatgctggtagggagtgggttggcactttccgggtgcattatccaaggtatatccaaaaacgccctggccgacccaggtttgctgggtatcaacgctggggcagggcttatggtcatcttatatgtgatgttcttcggggcacagtccttcctttcggtgtttactctgcccttccttgctctggcaggcgcgggagtgacggccagagttatctatgcgctggcatataagaaggaagagggcattgcacccatgcgcctgatcttaacaggcgtggcaatacaagcgggcatttccgcgctaaccaccttgctggtggtcaagctggacgacgatcagttcggctttgtggcgacatggcaggcgggcagcatttggggcagcaactggaagttcgtgatggctttactgccatggctccttttattgattccctatgtgttgtataaggcccgtgtgttagatgtgctgaatatgggggacgatgtggcgtgcagtttgggtgcgaatgtggagcatgaacggcgctggcttctgactgcatcggtagcattggcggcttcctgcgtggcggtcagcggcagcatcagctttgttgggttgattgcaccccatctgtcaagacggctggtgggacccaaacactcaatattgctgcccacctgcgccctgacgggcgctgtgctggtatctgttgcggataccatagcacgggtgatcgtacagccctcggagatacctaccggcattatggtggcgattatcggagcaccgtatttcctctatctgctggcaaaaagcagatagcgacgaaaggattgatatacatgaacagcattgcaacagagaagttaaccgtcgcctatgacgaaaaccttgtggtggaggacttggatatgcagattccgcaagggaaaataacggccatcatcgggccgaacggctgcgggaagtccacggtactcaaggccgtgggccgtatcctgaaacctaagggcggcatggtttacttaaacggggatgatattcgccgtctgaccacaaaggaagtggcgcagaaaatggcaattttgcctcaatctccccaggccccggcaggactgaccgtgagtgagctggtggcctatggccgctttccccatcagcggggattcggcaagctcaagcctgaggacaaagaaatcatccaatgggcgctggaggtcacaaaacttacggagcatgaaacaactgacgtggacaacctctccggcggacagcgccagcgggtgtggattgcgatggcgcttgcccagcagaccgacctgatccttctggacgagccgacgacatatctggatctggcctatcagctggaggtattggaactgctctaccgcctgaaccgggagcagggatgcaccatcatcatggtattgcacgacttaaatcttgcttctcgtttttccgactacatgatcgccatccgctgcggtgacatcatcaagcatggcacaccggaagaagtgatgacgaccggggtgctacgggaaaccttccacattgacgctgagattgtaaaggaatcccgcacaggccgccccacctgcgtttcttatgacctgattcctgaaatgccgaacgaatgtgatgattgcgagtgtgcatgttcatgaagaagctggcaatttacgggaaaggcggcatcggcaagtctaccaccgtttccaatgtatcggcggcaatggcggcaatggggctgaccgtcatgcagattggctgcgacccgaaggcagactccacgtgcaacctgacaggcggcaggaacatttctacggttttaaataccctgcgggagaacggcgatgcagagctgggtgatttggtggtcaaaagcagcaccggtgtgctctgtgtggaatcgggcgggccggtgcccggcgtgggctgtgcgggccgtggcatcatcaccgcctttgaaaagctggaagaattggacgcctatgaagtctttaagccagatgttgttctctatgacgtattgggcgacgtggtgtgcgggggcttcgccatgcctatccggggcggatacgccgaccaggtgtgcatcgtgacctcgggggagatgatgtccctctatgccgccgcaaatatagcccatgccgtcaagagcttcggcaagcggggttatgcttccctgcggggactgatcctcaacgctaaaaatatcgagggtgaaaacgagctggtagacaaagcggcagcggagattgaaacaagcgtcatctaccgcctgccacggaatcccctggtgcagcaggcggaagcagagggcaaaaccgtggtagaggcattcccggactccgatatggcgaaccattacaaggcgctggcaacattgctgctggacggaggcgaaggatcatgaaggatgaattaaaacacataaaacccttgtcggcggtgaagtcgggaacaggtataaggtttctgtccccagccgtttcccccggctgccactgtcctatgagaatggcggctctgacggcaaaggacatccggggactctcatccctgttggtgggtatgccggaatgcgccacccatgtgcggcttttcaatcccaagccggagggaaagcatggcgagctgcactggctgtatgtgctggatcagcatgaggtggtgtttggctgccgggacggactgatagatgccctcaaaaaaatgggcaaagccggtgcgaaggccatcctgctgatcgtcacctgtatccctgagttgatcggggaggacattgaaggcattatccgcgaggtgcagccggatatttccgcgcctgtggcctatgtaatgctgggacagttcaaaaacttcagttatccgcccggctattggaaaacgctgaaagctatgggttcgctgatgaacgcaaagcagacggagccgcttcgtatcaatgtgctgggccgacgtccgacggaggatcatatcgttatgccgccgctgcttcaggaactggagcgccgcgggctgtccattcgctatctcgcgccaggggctttcctgacggatttccagagcgcgcccgacgcagcgctgaatctggtggtttctccatatacacagcctttggcagtcagaatgaaagaggaattcggcgtaccatacgttgctctgcacactctcttttctgtggaagctattgacagggcttatgaagaaatcgcggagaggttcggttttacatgggctggtgaattctccaaggaacgggaaaaagcccgttccttggagaatgaagcggtgaaacggctaaacggacttcggtatattgtttctttgggggttggaatgccccttgctcttgccggttatctggcgggctttggcatggagccgctgcttttgcatatggaggaattctaccccgagaataaagatcacgccaaggcacttcttgccctggggcaaaatcccctcatctgccggatggtgaatttgaacgcggaatatccgattattgcagaaatggctccagatctttgttttgggcggctgccgccggagaacaagaccattcccaatgtggaaaatgtgtatcagttatatgggaaaattggttacgggctgactatagcgcttttggaacaaacgctgaaggtattacgcagagacggaatatccgagaaaggggtgaatgcctatgggactgcatcggtttaagccgcttccttcggggcgcatggggattctgtggacgcttgcatccattcgggatgcggctgtggtggaatttggctgcatggggcacatgatgtacagcggcgtgacactggagaacactggtgtgcgcggtgcaggcaggcggtactccacccacatcgacgaaactgatatcgctttgggcggcacggacaagctggctgcaaccatcgctcatgtggtgagatatgacaatcctaaagtgattttcctgctcccatcctccatcccccaggtgatcgggacagaccttcccgctgaagccaaacagttgcagcgggaatatcccggcaccctcctgctgcccttggggcacggtgggtttgagataacccagcaccggggagtacaggaggcgcttttgcggctggtgcaggcgctgccccgggatgcggataaaacgtcgcaaccgaccttcaatattattggctcatgtgccgatttgtttcggtttcaggctgatgcacaggaaattctgcgtatcatgcagggggcatttggtatgaaaccgctgtgcgtgctgacttccgatacctccatcgcggacattgaaagcatgggcggggcgcatatcaacctggtcattcggcgcgagggcgagagcgccgcaaagcatttgcaggcgcgattcggtacgccgtatctgattggccggccctacggtgtggagggaacggcgcgctggatccgggatgctgctgaaatgctgaacgccccaaccaaccgtgattttatgaacagccaaataagggaagtgaaaaaactgctttcggatatagctccctggcttcggcaccttatccgagatcaacccggagagatccggctctccgtcggtgctcacgccgatgtggtacggggcatcctcgatttcggccacggcgagctttccctgcccaaaggcacatgctggtgcgacagtcccgacatggcgggtgacggcatcccctatttcaccgaggaacagtggatgcaagcaatacaggctcagaaaaaggggctgttgatggcaagcggagaggcgctggaatgggcggatcgaaaccggacgctgcaaatcgccaatcccgatacgcggcggcggctgaatccctatgttccgccctttgtgggcttccgcggtgcgcttcacctgatcgacctgtggctgaacgctgcgctggagcaggaggagggcgaggaagattaatatttccatacactgctgaattttgtaaagtgggaacggctgtatgaaaaatctcactcaatcccagtcctattatatttgtgttttcattatgtgtaaaaacacctcattttcaaacagtatagaaagtgaggtgtttttccgtattcagtttactttatggggtgaattcacaacttgtccttctgacttcccggctttttgccgggcttttttagatcatatgaatgcaaagccattgtatatggggagcctggaaaagcatgtgctttactggaattttctcataagaaaagggattgcaatctacctgcattcgtgttattatgtccttggggtagagacattaaaagggaaagtgtctgcgtataaaagacatttttcgtctcacaaagacatataaaacaataaggaaggtggaggttacaatgaaagaaagaatgatgtatgcaattgtaaaagaacaggcggcgggtggtctggtccttagagaggtccccattccagtaacaggggaaaatgatgttaagatcaagattcactacacatcaatttgcggtacggatttacatatctataactgggataagtggtctcaggaaacaataaaaccaccaatgaccatcggccatgaatttgtaggtgaaatcgtggaaatgggcagtcatgtggggggatttaaaatcggtgatatcgtatcggggagggccatattgtatgcggtcactgccgtaactgtaaagcaggaaaacgccatctctgtaaaaataccgtgggtgtaggggtaaaccgtgacggagcatttgcacagtatctggtaattccgcagacaaatgtcatcatctgtgagccgggaatccccgaggaattatgctcctcctttgatcccctgggcaatgcggtgcatactgctttgtcctttgatatggtgggagaagatgtgctgatcacaggagccggtcctatcggcattatggccgctgcgatctgccgccatgtgggagcaaaacatgtggtaatcactgatgtcaatgattaccggctgaatctggcccgggaaatctgcggcgctcatactgtcaatgtagccagagagagtttagatgataaaatgagggaacttcatatcgaagagggctttgatgtgggacttgagatgtccggcaacggccaggcgtttacttcaatgattgaccatatgtataacggcggcaagattgcagtgctgggacttcaggcaagtgataccgtggtgccatggaataagatcgtggttaactgtctgcagttaaagggtatttatggaagggaaatgtttgaaacctggtacaagatgatggccatgctaaacagcggccttgagattgagaaaattatcacccacaaattcgatttccgggagttccagaagggctttgatgtgatgaacagcggacagtgcggaaaggtggttctggactggacgaaggcctgaaagaggaaggaaagaacgaattggcaaggttagtttattcagccaggcgtggaaaataaacgacaggagagagggaatattatgaaagaagcattaaactattttaaagaagcggtggaactggccaagggagacggaacttacaaggaagagcgcattatcacaactcctcaaaggagcaggattaatactaccaagacagaaaatgtcattaatatgtgtgccaacaattatcttggactttctgacaaccaggagattattgaggcggccaaagccacttatgacacatggggatacggcttgtcttccgtacgtttcatctgcggaacccaggggatacacaaggaactggaagccagaatctcttctttcttaggcatggatgacacgattttgtactcttcctgctttgatgccaacggaggcctgtttgagacactgctgacggaggaagatgcaataatcagcgatgcgttaaaccatgccagcatcattgacggcgtgcgtttatgcagggcaaaacgcttccgttatgccaacaataatatggaagagttagagcagtgcttaaaggattcccaggatgccaggatacgtctgattgctaccgacggtgtgttttccatggatggcattgtggcggatttaaaagcaatctgtgatctggctgataagtacgatgcgctggtgatggtggatgacagccatgcagtaggatttatgggaaggtttggcaaaggcacaccagagcactgcggtgtcatgggccgggtggatatcatcaccggcacactgggtaaggccctgggcggagccagcggcggatataccagtgccaggcaggaaatcgtggatttgctccgccagaagagcagaccgtatctgttttccaatactgtagctcctgcaattgcaggcggagctataaagacctttgaaattctggaacggagcacagagtacagagaccgggttcatgaaaatacccgctatttcagggagaagataaaagaggtgggctttgatatcatagaaagtgatcatccgattgtggcgatcatgctgtatgatgcaaagacggctgtagaatttgcagcaaggatgctggaacgcggggtatacgtcatcggcttctgttatccggtggtgccaaaaggaaaggcaagaatccgtacacagatatccgccgcccataccagggaggatctggattttgcagtggaatgctttaaacgcgtaaaggaagaaatggggatttgaaaaaccggcaatgattaactgaatcaatttttaaataagacataccgttgtccagtcgcttatgataaaatggtaaaaaaggggtggcagagatgaatcacaagactataaaaaattaccatgattttataaccgcattgctggaagcgggattttcaatgggaggaggaaacagtgaggatgttttttctttaatcacctggaattgggatgaacagccgccctatgatactccggtgcgttggcatacaggagattctgaaaccgatccatgggaatggcgcatgcgggtgttagatgagagagatgacattgcctatgcaaaactcttcttcaagaaaagcggatacattacgaaacaatggattccttattttcttgcagcccggcgtaacggtatactttttgaagaagcctatgaagaaggattgatcagcaattatgccaaacggatatacagcgttgttgccgaacatgaaatactgcctcttcatgcaataaagcagcttgcgggttttggaaaagaggagaaaagtcaatttgaccgggctttggttgaactccagatgaaaatgtttctgaccatgtgcggcaggcagcaaaaggtttccagtaagggtgaggaatacggctggtcctccacagtattctgcaccacggaaaggtattggggagagggagttttcaaagaagcatccaatatggatcaggccgaagccattgaaagaataacgaaacaaatttatacactaaaccaggatgcagaccctaaaaaggttatgaagttcatcaagggataattcattcagtactgtttattacaattcgaaattattaggaacctctcaggacttttcctgaggggtttttaataattaaagatcaagataccaatgcagtgatagaacccttttatccatgtcatttttattggaaggaccgcataaatcaaggcttattttgttgggtcaaattcaattcccgtattatatttttgattgttgatatactctttttgaggaataactttttccaaatcgatgtcatagcaatttgcaacagcaaggacgtagtaaataacatcccatagttcttcttcaattgtttctttgatttgaaattccgtttcaggacgtaaatttttccggatagcctttgccaattctccggtttcttcagataatttcaaatagtattccattgttaaatcaggattataatcttttgattttatgtattgctgtaaatacttgatcgtaattttacctttatccatttttcgttctccgagtattattaaatttattttaacaagatacagagctggtaacggttttattataccgccggcaaccctgcaaatcaatgctgtaaaaccctattgcccgaatttctgctgctagtctgtgcatttgcggaatacgttataaggctaatgatcctggagtatgttttgatattggggcagctggtaaagttctatcatgcgttatcgattatctgttgaaagcatacttttttgaactgcatttgaataatgatgaaatgatagaaccataaaaagtgggaacattaatatctggctgcttttctgcaagcaaaaacccctgtcaggcatgtggggtgagaagacggaaatgacagggctggatttatgtgataaaatgaatgttattaatctaatggaaatctgcaatgggaaaaaatggcgacgtacggtatatattttttgttcgtctttggagtacaggctggttaacctgaatatgtgaggtaatacatgataaaaaagatatttaacatcgctttttatgtaatggctattttctatgttttcttaatgtttgatttgtttttcaggattaatattatttctagcagcaatggtatatcgcgtagttataatttgatcccattcaagacaatctgggattacgcaagcgggaatatttatgtctcaaaatccatggttagatataatatccttggaaatatagcggtaatcattccgtatggactgtatttacaggtattgctgaaaaataaagtttttggcaaaagtctatggataataattggcacatctgtttccatagagatcattcagtatatttttggattaggtgctgcggacatagatgatgttatattaaatgtctgtggggtgtcattggcatcattgggtataaggtgctgcggaaattatttcgtgaggaaagcaaaacaaagacagctataaccttaatttcactcgttattggtatgccggttatgtttgtatactttatggtttgtatccgcaggtatttctgaaatcaggctgttatcaacagattgttcggcgatctgtgtgtagttccacataaatgaacccaatgggaaaggccgccctttcccattcttgttatagaagggggaatcatggaagattcacaatacaaaaaaaccaacattcaagaaacctccatccccgcatcagacatgttccatcgtatataaagctgttaaagtttaaccgaagcaagtagcgaagcggattgcggatatctgccgtcataagaattttaaaatcataaagttccttatgtgacatgatgggcttaaaatgcaaacaataggatcccagagaataatatggatgtaaatatattgacaacagtgtgctaaaatgatacaaataatgcttataagaaagaaatgtgattccaacgatataaagtattttcttaaagataatcccctaatacacttaagaacaaggaagtgaacccaatatgaaaaatcctttaaattatcaggtcacggaatacgattgcggtccaaccacattactgaatgcaatgagttacctctttacccgggatcagattccgccggatattatcaaacatattatgcttttttgccttgattcctacaatgccaaaggagaatttgggaaaaatggaacctcccgtatggcaatgatgtttttcagcaactggatcaaccaattcggcaaaatgaaaaagttccctgttcaaagcgattatctgactggggatgaagtgtatatgggggaaaacagcaaggtcatgtatggtctgcagcagggggagtagtggtagcgcgggtgatgtacggctgctggcactatgtattgctgacaggggctgacagccagtgcgtatatttattcgatccttatttcaggaaaaagccctttaagcaaaaggggttggagctgatcacagatatgccttacgaaagaaaccgttgtgtgccgtgggaaatgtttaacgacacaggaaagggcacttatgcacttggtcctaaggatacaagagaggcggtcattatttttaacaaagtgacacagaagaaaccggcagataccattgaatattttatttaatgcaggaccggtttccggtctgtttttcaaaaggggaattgcagcgaaatggcaaggaaaagtccggactgtcaatggacggagatatttttattgttttgagcatgcatatgtgatatatttgagttagttaaaactaacctactgattttgtgtctcatatgaaaggtggagagtatccaatgaaacttagtgttcaattatcaggcgtatcagaaaccatgctcattcccatgtatgccagggcaatagagagcaaaaaagaaaatccggcattttttgatcggtacgcgattgaaatgacggaaaaacttgactatgacttttcgaaattcgataaaggtaaaatgagcttatggggatgcgccgccagaacaattattttggaccgggaggtaaaagcttttatcaaggagcatcctcattgcacctgtattaatttaggctgcggactggatacccggttccatcgggtggataatgggagcatacgatggtacaatgttgactttcagccaattgccgatttaagggcacagctattacccgttgagcaacgggaaacaatgatctcttgttccgcgctggaaagcggttggattaatgaaattgcccgggatggcgaagtgctcatcatcatggaaggtctgatcatgtacttttcagtggatgaaatcaaagccctgatgggtatgatccgcgatgcatttccggactgtacgcttctcattgaattgctgtcttcctttacgctcaaaaaccagaagcagcacgacacgatcaataaaaccagcgctgtgtttaggtggggcgtaaaggaagctaaagagcttgaagtcttgtgcccgtatgggaaattaaaaggagaatggaactatactcctgtgatgaagcggttttcgcctttttttatcactttgatttctcccatactgaccaacgcaaacaatagaattgcaaaatttgagatttctgcggcatcataacaagagcagaagcattattatggttgcatttgcagcaaaataagtcggtggcgtagataaaaactattccgccgccttgccttttactgcttagtattttgtgtcctgggcggcggctgttccctctgtttctgccgcaaaatcctgtacacgcttatgcgtatttgtcaggcttcttctgcggcctttttttcatagcttattttatcatgctcgtgcttatgctgatggcggcgtaggctttggacagctgttctccgttcctttatgaatttagattgatcatattgttacataattccaattccttaatttcaggcatttccttttggactgaactggtcctcttaagcttaataataaagcaaatatatttgacaaaataagttctttgtgataacctgaatcaaattacaggtggaggcagccataatgaatcaatttcaacaactaaaaaagctgaatagggacgacgatcggtagcgcttgtatctgtgatgaatcataggtgcgagcgcttaacgcgttgtgcctgtgtggatggatattttacggaccacattggtagattaaatttactcgtgtggttctatttttttacccatacgaggaaaaagaaaggttgtgatcgtatgggacataatgataatgtcctcatggatatattgaatcgcaaggaaaatcaaaataattataatccaggaggaatagataatgaaaagtattgttggagccatagaaaaggtaactgttgaagcagaggagttagtaagccatatcggtgaaaatgtccgtatacacggcagcatatataaaatcagaaaaatgagcgatttcgcttttgtgttattaagaacaaaaagaaacgtagtccagtgcctttactcagaggaaatatcaaaatttccacttggagaattaaaagaagaaagcagtgtaatcataactgcccatgtcaaggcggaagagagatcaaagacaggttatgacctgcagatgctagaggcggaggttttatcagggccggaagaaccaggccctgttgtaatcaataataaatatgtcgatgcctccatggaaactttgcttaatttcaggccaatcaccctgagaaacgaaaaagaacgggctgtttttaaattgcaggaaggaatcacctatggaatacgtgagtttttaaaacaggaaaggtttacggagatccatactcccaagatcgtttacgcaggagctgaagggggtgcaaatatcttttgtcttgattattttggcagggaagcttatttagcacaaagccctcagttctataagcagatgatggcaggcgtttatgaaagggtgtttgagattgctccggtattccgggcggaaaagcatgatacttccaggcatttaaatgaatatatcagcgtggattttgaaatgggatttatacgcagctttgaagatattatgcagatggaaaccatgatgctcaagtttgtaatggaatatttgaataaagaatatgtcaatgaaataaggctgttaaaggcggttattccggtaattaaagagatcctggcaattaaattcaaagaagcaaaagaactgatttcaaaggaatataacagacccgtaaaggattttgatgattttgaaccggaagaggaaaaactgctttatgagctgataaaacggaaaacaggaagtgagtttgtgtttgtgacccattacccaagccaaaagaggcctttttatgccatggacagccaggagaacaaagaggaaacgttaagctttgaccttttgttccgggggctggaaataaccacaggcggccaaaggatccataaatataaagaacagaccgagaaaatgaaatccagaggaatgaatgtggagctgtttggaacttatctcatgatgcacaaatatgggatgccgcctcatggagggctgggattgggcctggagcgttttacaagcagactgctggaacaggaaaacgtaaggttttccaccctgttccccagagatatcaacaggctgacgccataatatcatgaaaaagcagaaccattgtaaaaggattggtttcctgccatatatcatagagcttgattttgaagaggagctgtgtacggataaaacagaacatctgtatatagaaaaggaattcaagggaaaatagaagatgagtaaggaatgatcatctattgccccaaccattattgggtaaaaattatcatttattccatgaatggtgtggtaaggatggagaaaaagtattataatagctgtaatagaatcgtctgattccatgagtatcgcagcaccacaaagaaaaataaaacatacatgcgggaggtatcttatgcagacatttaagcagttgtatgaaagtatggtgaaatccgtattagataataattcggatcccgagaaggacctggaaatctcatatgatcctcatcatctggactgtcttttaaatccccaaaagcatccggtggtaatccgcaccggaacctgtacctgttctaaagaggaccgggaggaatgtttaaagcgatgtcctttcggagccctggggatcgaaaaggatgggatcaccgttgatccggagttatgcctgggctgcgaaaagtgcattgaaggctgcgcgccggaaaagctgacggccagcacggatattattccggctttaaaggcaatcaaaagctccaaggggctggtatatgcaatgatagctcccgcatttttaggacagttttcaaaggatgtcactcccggaaagctgaggacggctttaaaagccgtggggtttgacggcatgctggaggtcgccctgtttgcagacatccttacattaaaagaagcccttgagtttgataaaaatattaacgatgtagacgattatcagctgacaagctgctgctgtcccatgtggatcggcatgattcgtaaggtctatcaccagctgattcctcatgtccctggttctgtttctcccatggttgcctgtgccagagtggtaaaggcgctgcatccggatgccttgaccgtgttcatcgggccatgccttgctaaaaaggcggaagcacgggaaaaggatctggccggtgcggttgattttgtactcacctttcaggaggtaaagaatatatttgacgccctgggaattgatccggcagtcatggaagagagtgaaaaggatcactcctcaaaggccggaaggatttatgccagaaagggcggagtcagtgaagcggtggagaatacggtaagagccattaaccctaacaaaaaaactgaaatccgcaccaaacaggccgatggagtgcctgcgtgcaggaaaatgatccaggatattatggacgggaagatcgaggcaaacttttacgaaggcatgggctgtgtgggcggctgcgtgggcgggccaagatccattttaggagttgagcaagggacagagctggtcaatgattatggagaaatggctacctataatcatccggcggaaaatccatatgtaatcgagctgctgcaccgcctgaatttggacagcattgaaagcctgttggaggaaacggatctgttcagcagaaatattacgtaaggcagattgcgttcataagctttataccatttaagtgaaatcagtacacgggaaccggaatgagaggttctcatgtgctgattttttgattttcctgctgaaatgaggataagggggtgattgcatcttgcttttccccccttaaaaatgctaatataaaagagtatgtatggacaggacagggaactggaagaaaggaaatggttatggcaacgggcagaatgaatcagctggtggtaatggtcaatttatgcagcagtgttgtggaaggaatcgaacaccttatggcctatgaaaaaaatgaacggctgaaagaggacgctgtcacagggcttctcaccttggaggagaatttaagaggatttaaggcagataaatccgtgatccatgaaacgagatggatggcggaagtcataaggaactggctgtttgtttttgatcaggaatttaaaagcaggctgtaccgctggtattttacagccttaaaagagcttcggaacctgatgacggcggaaatagagctgtgccccatctgctcagggaaaggcgttccccattatggagcagtgttttatatggaagacgaggaaacggatcaatatgtattggagccggtccgggtctttatgaagtgcagggattgcggaaattattatcttgcaaaggaagaacggggattttccggcggaatgaaagatttccgccgcacaaaggcaagatgtgaacggcttttagccgatatcggtgaatttgcggaagaaggaaccatgctgttcatcggagaagagaaaagccaattatataaggaagccagaagggccgggtatgatcctcatgccatgtccctggaagatgccggaaaccggaaagaggaaggaaaggggcgtaccggatcgtcctcattgaccggatctcccgcacccaggatatgaaacaggtcctgaccagggcggcggagtatttgggggatgacggagttctctggtttgacgggccggatctggataaatccattaaaaacctggagcaaaagggggcgtccatgtggaagggagaagcggcggaagtctgcttaacagatatgggaattgatgctctggcagaaaaatgcggactttccatacaatcataccgccatgtggggactgcttccggacgcattgaggtgatcgcacggaaaaaggaatgatataaaaggtatttggccatggttcatgccgcctcccataatggcagacggcttataagcagaatgaaggaaaaggaggggcagtgtgtttgacaaattgacagaaaatgatattaaaaaaatgcaggaagaaatagaacaccggaagctggttgtccggaaggaagctctggaagccgtaaaagaggcaagggcccatggggatttaagtgaaaacttcgaataccatgcggcaaaaaaggataagaatcagaacgaaagcaggatccgttacttagagaagatgataaaaacggcccaggtcatatctgatgaatccaaagatgatgagatcggcctttataatacggttgacttgtattttgaggatgacgacgaggaagagacctacaagcttgtgacaactgtccggggaaattccatgaaaggccttatcagctctgagtctcctttaggaagtgccattatgggccacagggtaggggaccgggtttatgtgaaggtcaatgaaaagacaggctactacgtagtagtaaaacgcctggaaaatacaaaggatgacggcagcgataagctgagaagctattgagctgccgaaagagttggataatatgatgaaggatatgacaagaggagatatttcctcccagctgatacggttttccattcctctggttttgggaaacttattccagcttacctataatgcagtggattccattgtggtgggccggttcgccggggaggaggcactggcagcggtcggaacggcaggccctgtcatgaacatagtgatcctggggatcacagggatctgcatcggtgcttcagtgctgatgagtgaattctttggtgcgggaaaccatgagaagttaaaaaaggaagtggccaccactcttttatttggttgttatttttccctggctattgtgattctggggcttttcttttccggagggatcataaggcttctccgggtgccggaggagatcacagaggatgcgaccgtctatttaaggctgatactcataggaatgccttttacctttttttacaatggagtggcttccgctcttcggagcgtgggggattcaagaaccccggtccggtttctggctgttgcttcggttttaaatgcaattctggatctaatatttgtggcagggttccatatgggggtttttggagcggccttttctacagtcattgcggaggctgtttctgcatttctgtgcatcttttacatatacagaaaggttccgcttctcaggcttgggccaaaggatttccgcatggaccgggaacttttaaggcttacggtaaagcagggggcgtcacggcgctgcagcagtcctgccagcccattggcaagcttttgatacagggagtcataaatcctctgggagtcagtacgattgcggcattccaggcggtaaaccgggtggatgattttgcttttaccccggagcagagcatttccagcggaatgatgacctttgtggcacaaaaccggggagccggtaacggggaacgggtgaagaagggattccggaccggactttttatagaattcagttactgggtgattatatgcatcgtcattctgctggtaaaggagcctgtaatgaaattatttgtctcccagggagatggggctatggtcaggatcggagcagaatatttaagccttatggcatttttttatcttcttccggcatttaccaatgggatccagggatttttccggggaatgggaaatatgtccatcactctgatttccaccttgatccagatatccgtccgggtggtatttgtttatctgctggttcccaccatggggatgaaaggcgttccctatgcctgtctcattggctggatatgtatgctgatctacgaggttccgtattatttctggtttaaaaagaaaaataaattattacaggagtgaaatgatgattaaaaatatcgtatttgacatgggaaaagtactggtccattacgacgcagacatggtttgccgccattttattgaggatgaggcagagaggaaagcggtaagaatcgctgtgttcgaatctcatgaatggctgtttctggatatgggagtgatctcagaggaagaagcattaaagaaaatgcaggcgcgtctggacacagaacacgcaaaggaaatggcggctctttgcctggaacactggcatgaatataacatgtggcctgacaaggagatgggagaggtgatcaggcagcttaaggagaagggctatggcatctatctttgctctaacgcttccctccgtctgctgacgtgttacaatatcattccaggaatcgaatattttgacgggattttgttttccgcagaggtaaagtgcatgaagcctcagaaggaaatgtattgccatttatttgaacggtttcatttaaagcctgaggaatgctttttcattgacgatatgcccttgaatattgaggggcaaaggcctgtggcatggatggatactgctttgccgacggagatgttgcacggctgaaggaatttctgtcccatatcaatggtgactaggaatggtatggcagcatgagatcttatggtttggacaatgaaatggagaaagacttattatgtaccggattcagataaaggatatggattttgaacagatcgccagatccggccagtgctttcgcatggaaggccgggggaagacaaccgggtctggtcggtcgcggcagggggagaatatgtggaagcagtaaaagaagaagatggctttctgttttcctgcggggaaaaggagtttgaagaaacgtgggccggttattttgacttgcagaccgattacggcggctataaaaagcgtgtggattctgaggatttttatctgaaggaagcaatggaatggggctggggtgtcaggatccttcatcaggacttatgggaaatgctggtgaccttcttgatttcccagaataacaacatcacccgcatcacaggcagcgtgaaggaattgtgcaaacggttcggagacaaaagaaaagggctgggtcttgccatgtcttctgacgggagctggatagaaacagaaagaagctatgatgcctttcctgagccggagagcctttccgcggcaggtcttcaggggctgtccggcctgggccttggttaccgggacaaatacattttgtcaattgcagaagcctgcagcaggcaggagggaaaagaatggctattacgcttaagggaagcggattatgaaagcgcccataccatgctcatggaacagtatgggatcggaagaaaagtggctgactgtgtctgccttttcggccttcaccatgtgggagcttttcctgtggatacccacgtaagacagattttagaggttcactatcctaagggttttcctctggagcgttatcaggggtatgccggaatccttcagcagtacatgttttattataaggtaaatcaaatctcccgcagcaagttacggggaatttgaccttgcagcatttgccggttgcaggaatacaaacaatcctgcgcctggctcattgcttacggaaataaactgttaaaaaggaacttattcctttgtcctggttgcctgtgcagcggaagctgccaggcgttttttgtattacagggaaatgcattctatgatataaaaacctctggttcgcctctcgggtctgcaaagcagactctttgtttatttaaaataatgtcgaaatatttcatacttttatcacacaatcaacaaaaatatatcacacaattttcacaattcccttttaccctaagtaaggatgcaaaaatgcataaagaacaggaggagagagagttgattgaagtcaggaatcttgtaaaggattacagcggccatttggctgtggaccatttgagctttaccatcagcgacgggcagatatatggttttttggggccaaatggtgcaggaaaatccactacaatgaacattatgaccgggtacataggggcaacggagggcgatgtgctgatcaacggccataacatactggaggatggggaggaagcaaagaagtgtatcggctatctgccggagcttccgcccctttatgtggatatgactgtaagagagcagctgctgtttgcagctgaattgaagaaaataccgaaaaaggaaagggaggaagctgttcgtgaggttatggagcttgccagactggaggatgtgcagggccgcttgatccgcaacctgtcaaagggttacaggcagcgtgtgggccttgcccaggcggttatagggtttcctcctgtcatcattctggatgaacccactgtgggattggaccccaagcagatcattgagatccgggatactatccgcgagctgggtcgaaagcatacggttattttaagctcccacatcctttctgaggtcagcgcggtgtgcgaccacatcatgatcattgacaaaggaaggctgctcgccagcgatacaccggaaaacctggaacaacagatggccggaacagccggaatggagcttttggtcaagggagaggaagaacagatacataaaaccctggaagccattccccaggcagccgatgtgtcactaaaggaaagcggggaagagggaatttacagggcattgttccgcatccgtacggatgaggagggaaatggagaggatatccgggagactattttctttgcatttgcagaccaaaggattcctattctttctatgcatgaaacaaaggcatctttggaagaggtatttctggaactgactgcggaagcggacggcggggaaatagaagatgaggagaccggtaacgaagagaccggtaatagagagacagacaacgggctgacagataacggagatgcaggccaaggttttgaggaggctgattttgagggatctgaagaatatgaagagcctgccgggacagcagaccaaaaggaagccggtggaatcggagaggggatgaagaataatggcagcaatatatagaagagaactgaaggcctattttcagtccatgaccggatacgtatttattgcctttatggtgctgttcgtaggcatttactttatggcctataacatgatgagcgggtatccttacttttcctttaccttgtccggcatggtgaccattatcatgatcggcattcctgtgcttaccatgagaagctttgcagatgacagaaagacgaagacagaccagctgctcctcacttctccggtatctgttacccagatggtacttggaaaatatctttccatgacaaccgtatatgctatccctgtactgcttttcggaatctgcccactcattatcaagctgaacggaaatgcaaatttgaaggcggattatgcttccatactggcctttttcctgctgggctgtgtctatatcgcaattgggatgttcatttcgtccctgactgagagtcagatcattgctgcagtaggaacctttggaatcatccttttactgcttttatggcccaatcttgtgggatttttgcccacctctgcttccggatctgcaatagggtttctgatcctttggaccggaatcgtttttgccgtacaccgggtcacaagccatggccctcttgcagccgttttggaatcggccggagttctttgcatcggggttctatactttgtgaaaaagggcatttttgaccgggctttgacaaatattctggaaaaggttgccataacggacgtattccagaactttgccagtcattacatctttgatgcaggcggcctggtttactatatcagcatcatatttctgctggtatttttgaccgtgcagtccatagagaaacgcagatggagttaggaggatggaaatgaccagaaaattaaaaaaaggcggctacacggcgattctttccgtgatcgtcatagcagccgtggtaatattgaatttgatcgtaggccgtcttcctgagaaggtgcggcaatgggatatgagcagcagccagatctacactctgggaggaactacaaaggatcttgtaagggcccttgataaagatataacgatctatgtggtagctgatccggcttctgtggataagcggatcacaagctttataaaacgctacgaggatttatccggccatattaaggtggtgaccgtggattctgtccttcatccggaccaggtaaataagctgaaggcacaggacaatacccttttggtaagctgtgaagccacagacaagacagaaaccatcgccctgacggatatcattaagatggatgaaatgtcctactattattatggacagtctcaagaaacagaatttgacggagaaggcaagcttaccggagccatttcccatgtgatcaacaacgtgcagaaaacggtttacgttacagagggccatggagagggagctctaggggatacggcatctgacatgctgaaaaagtccaatctgaccgtgaactccttaaatattctgacagaaggcagcattcctgaggactgccagcttttgctcatcaacgccccggcctcagatctggccaatgacgaaaagaaaatggtctccgattatctggacaaaggcggaagggtaatgattcttgccggctactcagagaaggaccgtcccaatctcaatgctcttatgaatgattacggtctgaatctggaaaatgggcttgcggcggataccaagaaattttaccagaacaacccttactatatattcccaaccattcaggttggaagtgaagtgacaaatggtattgatggaaaaagcgcggcccttgtccttcagtctgcagccctgactcagaaggaagaactgccggaaggcgtggaagtgactccatttatggaaaccagtgacggaggcatgctggtaactgccgataagcagacccaggggacctatattctgggggcagtatcagagaaaaccctggactcaggaacagcccgtttgaccgtgttcagcaccccttcccttattgatgagggtctgaataccagcttctccaatttgaccaacttaacccttttcatgaacgcagttacctccaatttcgatgacgtttccaatgtgtccattccatcaaagagtctggaagtgacctataataccgtcactcatggaggcatgtgggggatcctgtttatctttgtcatccctgtggtgacgctggcagcaggactggtgatctggctgaagcgcaggcgtctgtagaaggaggcgtggacatgaagaagaaaaaaggccttatatacggagcgatcgccctggtggttttatgcgtgatctatgggggagtgggaagatatatgaatcactctcagaaacaggaaaaggagaaggcagaaggggataaggtctatctcaccgacctatccaatgttgcttctgtttcttatgatattgacggtcaggagctctccttttcgaaaaaggacggcaaatggaaatatgacggagatgacctctttcctgtaaatcagacggaagtggattccatcgcttccacggtttcaaagcttgaggcattgcggaagctggaaggaggggacagcttaagcgcctatggcctggatcagcccgtcagaaagatcactgcagccgcagaggatgggacgaagtctgtaattctgctgggcaatgccaccggagacggggattattatgccgctgtagagggacaggatacgccgtatctcatcagttctgccctgtacaacgaaaccggcagcagtctgactgatcttatggctctggaagaatttcctgccgtttccggagccgacataaaaagcatcacaattacaaaggaaggctccagtgaacattttataaaaaagaaactggatgataaagaagggaccatcgaatggtaccgggattctgtggaatctcagggcaacaagctttccgataattccggtttaaatgttctggcagattctttaagcagcctgaaggtgaaaagctgccctaattataaggtgcaggaaaaggaattggcagactacggcttagatcagcccgctgcggtcataacctatacttacgataagaatggttcagaagaaacctttaccctgtcaataggttccttaaacagtgattccagctgctactatacccgtacagataattcttctaatattaatgaaattgaaaaagcttctatagataaatgcctgacagttgacaagggcatttcataaaaaataacctgtcccctggcggaaaggcatagaaaggagggggagacccctcttttctatacccagctgtcaggagacaggttgcaggcgctaaaatgtatagttatccacttctgttttatccatttcttgaaacgcgtcagcgttgaaattgtttcctgtctgaatggttacaagatttatgtgtatccttttgttaaatatcttggaataaatccttaaaatgtttttgattcattgataataaacatcttttttctcttttctcccatgcaatctgggcataaatatctggcatattatctctttttcagagtgactttagaatggtattaagggcatgaagctgtcctgtttcctgacagagaaggagtacaagtcctggatcccttcataccagatgttttacttcattattacttcgggcctttacattggtgcaggcccggcttttttgccttttctcataggacgatacatttcctcatacggggagcggatatggtgactcggatgggaggtaaatcaaatagaactgtaatggaaaagcatctgtttttgagtttctcatctttgtgataataaaaagcattctttttcttttgacaggattggcttgaatgtgagcaattctctgttttggaaaggtgtataaagcaagctgcgggaattaaaccctgaaagatataaaagcatataattaagtgtaaggagcaaaaagccctttatattatgatttttagctttctataaaatgcttgtaagtaaaaacgtaacatcagatcctaataggagagaattataatggggaattgtagaaattgtaatgatgattgctgctttaatggaagcagatgctgtaactctaatgggtcacaggggtgcaggtgttgtgtggggccaacaggaccacaaggcccgagaggctgcccaggctcgactggaccaacaggagcccagggtccaactggcccaacgggggcaacgggagcgacaggagcccagggtccaactggcccaacgggagcaacgggagcgacaggagctcagggtccaactggcccaacgggagcgacaggggctcagggtccaacgggggcaacgggagcgacaggagcccagggtccaaccggcccaacgggggcgacaggagctcagggtccaactggcccaacgggagcgacaggagcccagggtccaactggcccaacgggggagacaggagcgacaggagcccagggtccaaccggcccaacgggggcgacaggagctcagggtccaactggcccaacgggggccacaggagttcagggtccaacgggggcaacaggggcccagggtccaactggcccaacgggagcaatgggagcccagggtccaactggcccaacgggggagacaggagcccagggtccaaccggtccaacgggagcaacgggggcgacaggagctcaaggtccaaccggtccgatgggagccactggggaagaaggtccaactggcccaaccggtccgaccggagccgctggggaagaaggtccaactggcccgacgggagctacaggagccgaaggcccaaccggtccgacgggagcgacaggagccgagggcccaactggtccgatgggagccactggggaagaaggtccaactggcccgacgggagccgagggcccatcaggtccaattggtccgacgggagcgacaggagccgagggcccaacaggtccaatcggtccgacgggagctacaggagccgaaggcccaaccggtccgacgggagccataggagctgagggtccgaccggcccgaccggtccgatgggagcgacaggagccgagggtccaaccggcccgacgggagccactgggatagaaggtccaactggcccgacgggagctacgggagccgagggcccaacaggtccaattggtccgacgggagcgacaggagccgagggcccaacaggtccaatcggtccgacgggagctacaggagccgaaggcccaaccggtccgacgggagccactggggaagaaggtccaactggcccaacaggagccaccggagcgacaggagccgagggtccaaccggcccaacgggagcgacaggagccgagggtccaaccggcccaacgggagcgacaggagccgagggtccaaccggcccaacgggagccacaggagccgagggcccaactggcccgaccggagctacaggggccgagggcccaaccggcccgactggagcgacaggagccgagggtccaaccggcccaacgggagcgacaggagccgagggtccgaccggcccgacgggaaccacaggaactgagggcccaacaggtcctactggcccaacagggcctgcgggatcgaccggccccgaccgggcaggagtgatcccatttgccattgacaacgaatatgctgaagtttccacagatgatcaggggaatccgtcaattattcaatttgctggatttgaagcaaatcagattaattcaggcaggcctacacagctgcaggaaggtgattgggaagctggaataattacgtttaattttaataattacgatcaattttaccgcagttgttttgtaatgccttatgacgcagtggtaaaaaacatctatgtgttatttggcgcaaaattgtcactttttttagatgacggagtaaccatgtatccgtttgcggctcttgcagtgttaacctcagatactccagggcaaacgacaggagggatggtatttaccatacttcaggataccctgacttattcggaaccgtttacagcgccggaaggagggggagtggttcccaaatatacactgagaagaggttccacaacagatatcaatgccctcattccggcaggttctcttgttggcattatagtcggatgcagagcagaaggagttacaacggaaacattcggcagattctcagtcagcggtggaattttgcttgaataaatacttgaatagacgatagaaaaaggcctgtgatcagcttgtttgtatgatgcaggccttttaaaaaagaaatatctgaaaaaaggaggaaaactgcagtggtgatccatgacgaaattatccgtctgatagaagaaacggcaaagctaccggtttctgacagaaaacgcaatctttataaagacctgggctttgattccctttcctttatccaccttttgcttaagatagaagatatgtattccattacctttgacatctcagaaatggaatcctgtctggaagtcagccagctgatcgcactgactgaaaaaaaagtaaaggagaacatgaaaagatgattagaaatctatttctgaatcccccactcccccaaaaaacggcagttattgatggggaagccagcattaccttccaggacctcatacaaaaagccataagcattcaatcctgcctgccccggagtcattgggaaaatgccgtaatatttttacctgacgggagcgattttattgccgctcttttcggcatattcttaatggggaaaacagcatttcctttaaatgtccatctgacgaaacacgaaatgattcctttgcttaaacagacagacacaggcattatcattacatcccaaagattccatccggtttttgaagagataaatgccgggccagtccctcatttacaggtgatctatgtagaggaatgccagccaaaagaatctatgcagcttcttttcgaacccagtacaggatcggatgtaccattggtcctgttaaccacatcaggctctacaggcagagtcaaaattgtgcctcttacggagaggaatgttgaaacttctgttttgggttatattgacagaatgtgttatgaagacatgaatgaggaggaaattaagtatattcttgcagttccgttttcttcagcgtacggcctgatgatcctgtgtgcctgtcttataaaagcatttcccttggttctgcttaaggaaggctttactttggactccttttataaaacggttcaggaccatagggtgactcactatgagggcggggcaatgatccccctcttaatggagcagacagcaggaaggcccatcccttatgatattcatttattaaaatactacggtttcgggggaagtaaaatttctggtgctacattgagaaaccttttaaatgcatatcccggaatccagctctggcagggctatgggatgacggaagctgccccgctgattacaaagtacacgaaaaccagtgtggagaagctggattccgtgggaaaggcgataaagggcgttaaaattttcatagaagctgacggtatgatcacagatagcccttataccaatggagaaatccttgtaaagggacttaacgtgatgtcagggtattaccgaaatcaagaagaaacaaaggcggtgctgaaaaacggctatttgtatacaggcgatcttggctatttggatgaggaaggctatttgtatatttacgggcggaagaaaaatgtgattatcgtcagaggatttaacgtatatccggaggaagtggaagcctgtatcttaaacagcctgcttgcaaaagactgtgttgtctatggagaaacggatgagtggggaaatgaaactgtctgcgcagatattattccggccgatacccagtccagccgggaagaaatccaggaagagatcagagcttactgcaaagtgcatttgtcaggatttaaacagccccggaaaataaaaatagttgatacaatcagaaagactgtgtctggtaaaaatgaaagaaggagagaagaacagtcatgagtctgatttattttcagggattaaactgttattccagcagcatattgaatgctgctgttttcacaggtgtggattaccggaacgcttttgctaacctgtggtcagaaacagattttacgtatgatcagatccatcatctgtatttatccagaagaatgcctgttaatctggaggctctgggtgtaaagctggaatttctgaattgctgttcttcagaagaggtagaaaaaaacttatcgcggctttcccacgggcaatggctggtagctggaatggatgccttttttattccgtggactccttatttccagacattgcacagctttcattattttattgcaaggaaagagaaggaaggcgtattttcctgctttgaccccacgtatgacagaaaggatatggagataacggagaaggatatgattttccacgcctttgatatttgctggatttataaaactgcggaacaacagtctgatatgagcatccaaagggaagcacaggaaattctgcattctcatccaggaacacaggaaaatctcctcgcccaaatcagggagtgtgcttatggaaaacagaaaaacggggaattgcttgcaaagtacatagatgctttgatcaataaccgttatctctatcttcattatcttcagaacatgccgttgtacaagggaaagtatgaccagtatttttctaaagaattctttctcaagtggacggcggtgaaatatggattatacaaggcctcaatcaggttgaataaccaggaactcatccaggaagcatgcggacatttccaggaactgatagaggaagaaatggacattgcccggaaaatagggacagtgttataaaacttctataagccttcatgaatgaatagacatgtttttaatcattattattaaagcgatagaagagattttagaaaagaaaaagaatatttcagagaattggtgaattttcggcatcaaaaaagtaaactgtatcctgaaagaaagatatagaaaagaggttgacatcctctgcttctatctcaattgtcaggatacagtttacatatgctaaaatgtatagtcttccaattctaccttatccacttcctggaatggcgccagtgtggatatcatctttacgatgttcctgtagggattaaagcaatagtgagtctccgaaggctcaatatggataaaatccccctgttttaaatgatggacgactccatctacaacaatgttaacctctccctcaagaatgaagaaattctcttccatcacgttatgataatgagcggtgaaatcctcacctggctggaattgcaccactgcaaaattcatgcgtggacctttcattaaatattttggaccgctgttgccaaaacggaattctttctctgattcattgatgataaacatatttttttctcctttttcttcacttataagccaggtgcaatccacatattctttgtgattttacgatcacaaagaagcagctgggcttggtaaaattctctccagtttttataaatcccacaataaattctatgattctccatgtttggcataaactggtgctctatggttaccagttcttttgcagtctcagcaatatcctgatacatgccgatcccatatcctgccaggatggcagcacccagcgcagtggcttcctttactttgggaacctttacagggagtcccagaacatctgagaggatctgggcccagagagagctgtttgcggctccgcctgcaaatgtgatttcttttggaagatggccggtggcctcccgaaccagttctaaatgtccctttgtaaccaaagccgtattttctaaaatcgcccggtagaaggtatagtggttgtatttctgaggatccagttcaaagttggagaaagttggtgcagcatgtttccagtttataaagttcatcacatctgaaaaagtgcacatcatgccgtagcagcctgccggtattttttctgcttcctcattcatcaggtcatagacactctttcctgtttgatctgccagccttttttctgcatgacagaagctgtcccggtaccagcgcatgacaagtcccggctgaaaggcgagggcttcatattgccatatgcctggtatggcatgacagtttacccggacacggcagccagggtctgtgtctggcttgtctgtattgtattcgtactgccagaaactgcctccgaataatgcggcttcctctacatgcacaacacctactcctatacaacctaattgggcatctcctccgcctacgacaaccggaattccttccggcagtcctgtatggcctgtgcagtcagaagatgttctcccgattactgttccgcattcctttacaagggggaatatatccgttcgtaatccgcatcgcccggcaatctttggattccagaggcgggtctttaaatcaaatagtccggttgtagatccgttgcttggctctacggccaggattccggtcagcttaaacataagccagtcgttgaacataccaatgtatgcaatccgttcataaatatccggcattttattctttacccatagaagcctgggaagggcatccagggcataagactgtcctgtttcgtaatagaggaggcgttccagttctggatcgctggaaatcagctgttttacttcatcattgctccgggcatctacattggcgcaggcccagatttcttttccgtctttgtcgtaaagaacgataccttctctcatgcaggtagtggagatggcggctatctcataaggttcgccggtacttgagcataagaccctgcggatacaggaggaggcaagctcccagttcctttcccagtcaaaatccatactccccggatacttaggatcctccctgtgttcccattcctcctgaacacaggagagctgattgcccttacggtcaaatagtactgcacgaatacttccagtgcctgcgtcaatagctaaaaggtaatttgatgacatatccattcctccattctattttcatttcggcgaatcaggatcttcttccatcagttttattgctgtttgttcatctgtgatcagcacatttaaataaccgccctttaaagaagcgcgtatggctctgactttactgtctccggcggcgaccccaattacattgggcagggtgcgcaaggttgcaagagatgtgcttaacagccggtcctcaatatcagtatggacgggatttccatctgcatcgatgaaatggctgaggatatcgcctacggctccctgcatggacaggtagagaaagtcatttttcgtaaaaattccattcttgattatggttgcatcttctttgattccccctatgcctaccacggtcatggaagccaggttcaccatacgggatatttcctgtatggaaggttcgttttgcatggcattgcatagctctttggttgaaacaaccagaggagcgggataaagaaacagctttgcgttaaacctgctggaaaatgcatttggaagataatagctgacacctcctgttaaagatacggcagaaagaggtgcttccgttatgttggccagatgattgattaccctgcccagggtatctccgtatccgatgttgacgtatgtgttttctgtgatccggtcactgatgtacatggcggcagctttggcaatggtatcgtttaggcaggagacatcaggggcagagggaactacaaacgcatcttttaaactccatctgcggattatttcttgctcgatttttaagtgacggctccgttcctgggaaatctggaactgtatcacaccgtcctgtctggctttttccagaagcttaatcactttcatacgggatattccgagtttttccgagattttttgctgggtcatattttctatataataataccacgctgttttgataataagggaatcttcataattcatgtcttggtctcctattcgtatcattcgttctaaacaaatgtttttgtaatgataaaatgtttgaatttgtacttagtatagcaaaggaagatctatatgtcaatagtgccaaaacaaataaaacatcacaaaaatatgtgtggtaattttgataaaacatagaagatataatgagaaatttcgtataaaatcaccatgcttttggaaaaggctattgacaatacgggctatatcatgtatgatgtggacatgaaacaaaagttagcatatgaaacaaaaatatcaactttgatgggtgggaggaaatatgaagcagtctgaagcagcccgtttggaacaggtattgttctctgtcagcgatattgttaaatcatttggctccaatgctgttttaaaaggaattgatttaagcgtgagagagggagaagtccttgcgctgatcggcggaaacggagcaggaaaaagtaccttgatgaagattattatgggcatatatcagccggatgccggaagtgtaacggtagccggggaaacactttcggtatttaagccgtctgttgctcttgcaaaagggatttatatggttccccaggaacccatgctgtttccaaacatgactgttgaggagaacattctcattggttttcatgaaaatacggccattcttcgaaaacgtctgcaccagatcatggatgagattggctggcacctggacaccgaccggaaggctatgagcctttccatagcggagcagcagctggtggagcttctcagagggttgttaagacaggcaaagcttcttattttagatgaacccaccagcgccctgacctttgatgaggtggaaagccttttccggattgtggaggatttaaaaaagaaaggaataggtatcatctatattactcaccggttggctgaggtatttcagattgctacccatgtggcaattatgagagacggagtgattacattaaagggaaggacttcagattttaccagagaaatgctggttaaggggctgcttcccgccaatatggatgggcagaaggaatgtgaaaaaaaggaatcttctgatctggactattctgaactgaaaccggtatttgaattaaaaggctactcgggttacggattcaaggatatggaccttaagatctaccctggagagattcttggagttgcaggagttgtgggggctgggcgtaccgagcttgcagttacgatttttggaaaagataaggttcttagcggaaaagcttttctggatggaagagatgtgacaggcctctctaccagggaaattttaaaagccggtattaattatgtaccggaggaccgccgcttaaatggtctgttcggaatcagtgatgtggcagcaaatactacctctgccttagttccggggaaagctcttgggcggatattcttaaacacaaggactgagcggggaatcacccggaaatatgtggaggactttcgtattaggattacgggccaggatcaggcggcgggaagtctttccggaggcaatcagcagaaaatagtcattggacggtcactgtctacaaatccaaggctggtgattttggacgagccgacacggggaatcgatgcggcggcccgcggcgatgtgtatgcaattatccatgaactgaaaaggcagggagttgcggtcatgctgatttcttctgatatggaagagatcgtggagctttcagacagggcggttgtggtctttcagggaaggcttaagggagaactgagcaaatgtgagatcagtcaggcaagccttatggcggcctcctttggggtgacggaaggaaagcaggtgggggcatgaagaaaattggaaaagtccgtgagttaaacagttttctgtttctggcggggctgatttttctggtaggcctggttaaccggagtttctggcagccggcagtcatatggaattgttttaatgacagcgttgtatttacgcttctgtcagcaggaatcgcatttgtcatcctgacaggggaaatcgatgtttccattggggcggtactgggcttatcggcagccgtcggagctacacttttaagggacggttatggagtgataacagccgccgcggctgcccttatcatcggcattctggccggactggtcaatggggtgggggtagcgatatttcacattccatctctgatttttacactgggtgttaatggtgttgtacggggcttgatttatgtatacacaaagggagcctgggttgagaatcttccggctgcatttaccagaatgtcaaaccgcatgcttatgggaaatctgacggttttttatgccatgacagttgttatggttttgattgtccatctcgttttgacgaagaccaaaaagggaaaatattttatcgcagtgggggatcatgaagccggtgcaaccctggttggaattccggcagataaaacgaaaatcatggcatatgtcctgtgcggtatgtttgcttctgctgcaggtatgatttatgcgtcccgcattggttttattacgcctacggcaggtaacggatatgagatgaaggcaattgcggcatgtgttctgggggcttaagtttaaatggaggaattggaagcctggcaggtgcatccatcggtgcggtaatcatgtcctccatcagcagaatccttgtgtttcttggcttctcttccgattatgacaataccatcaccggcattatgctgctgaccattgtggtaatcaataccgtggcgcagaaccgggcggctgagaaaaaccgccgcaggatcttgtctgccaggactggtggaaaaggaggagagaagaaatgaaagcttctgtctggaaaaagtgggaatttgcacttttcttgattttgattctggaaattgttgtctttgcgtcaaaaaacagcaaattccttatgcccagagtgctgtttggcagtatgaatgacattatttccatttgtatcatttcgctgtttgtcacctttgtcatgattacgggagggattgatatccaggccggttccattgtagggctttcttccattattatgggagttgcctggcaggatgggggagtgaatatctgggcggcttccctggctgccatagctgctgcgggactgtgcggcgctctttccggctattttatcgcatactgcggtgtgcagcccatggtggttactcttggagggagttttctgtattccggggttgcgctgatggtgtcaaatttgtcagcaacagaaagctacaaagggatcagcggtttcccggatagttttttaaggctctctaaaataaagctgtttggcgtcattccaagccaggttatcatatttctgatcctggcagtactggcttattttcttctgcataagaccagatatggaagacaggtatttctggtgggggtaaatcccaatgcagcggaatattcaggcattcatacaaagcttattatcatgagtacatatattctttccggaatcagtgcggctgtggccggaattatccttacctcttatcttggtacggcaaaaagcgatattggttctacactgaccctcccatcattactgcagtggttctgggaggtaccttaagtacaggagggaaaggaagtgtacctgggacggcacttgccgcagtggtgatcgggactttaagattcggacttccgctgtgctttaaggtgagccagcagtatctggacattccggcagggattctccttctggcagtagtgacgggacgggcattcctgaataatccgggtttgagagcacgttttctgaaaagagagcggaagtgactgataaaatgaggggaaaaccttatcattataaaactatataaagcatattaaaggaggattttttatgagaaaagcaatggcatttgtattggcgggactgatggcggcgtcactgtctgcctgcagcggttcggaaaaacttactgacacaaccaaggcagccggtggggaaacaaaaacagaatctaaagcggaagaaggcacgggcaatgccggttctaccgatatttccggaaaaacagtggcatttattccaaagctgacgggtaatgcattttttgaatcagccaatgcgggagcccagaaatacggaaaatcctggggaattaccgttgattatcagggaagcgccaatgcggccgtagcagaccaggttcaggtaatcaacaatgcggtggcaagcggagtggatgccttatgtgtttcctctgtagatgcgacgggacttgactctgcattaaaggaggcaagtgatgcaggcctgaccgtggtcacatgggattccgatgtttctgatacggcacgcaccttgatggtttcccagggaacgccagagatgcttggcaaaatgcttgtagatatgggggcggactctttaacaaatagggggaaggatgtcaaagcggatgggattaagtactgctggcactattcccaggcaaccgtggcagatcagaactcctggcaggttgcgggagaggcttatataaaggagacttttcccaattgggtgaatgttgctcccaataattattattccgaacaggatgcagaaaaagcagtatccatcggcgcctccattctggaagccaatccggatattgatttgattatctgcaatgactctacagcacttccgggtcagtgtaaggcggctcagaacaaaggaattacaaaagaagatgtgaccatcaccggttttgcttctcccatgtccattaaggattactgcaatgcaggtgtgatcgagcagtggggactttgggactgccaggttcagggtgctattggctgctatcttgccgcctatttatctgcgggaaatcaggtaaaggtaggagataagattgacataccggagatcggcgctgtggaagtaatgcccaatgactgtctggttgagggagccactaccggtgaggtaaacaatggagtcgttctccttccggagcgcacggtatttaataaagacaatatgaataactatgatttttaatccggccaaaccgctgggtgcaatgacagtaaaaggagagaatgaacatggcagatctggaaggaataaaagtaacacataattattataaggatgtactctttgcaaataataagcctttttatgtaaaaggagccaatcaactggattggggaatgaaaaagcatttatcgaatatttttgatgagagcagcgggaatacggtcatgtttgcatttgaccatggatactttatgggttctgttgccggtctggagcgtttggacttagtggtgcccaagctgcttcccaacattgatgttttaatgggaacaagaggggcgctgcgaagctgtgtgcctgcagagggaagaaaaggcattgcacttcgcgtcacctccggttcttccatgcttgatgaggacttgtcccatgaggttctcgctgttgatattgaagatgtgatccgtatgaatgcggattgtatggccgttcaaacctttatcggagcggaaggtcagctttcaagccttgataatctgtcaaaagcggtgaacttaggtgtgcgctatagcatacctactatgggagttgtggcagtaggaaagcagatggagagaacagaccgcttctttaagctggctacccgtattgtggcagagttaggagccaatatcataaaaacctactattgtgaaaactttgaagaagtggtatctgcctgcccggtacctattgtagtggcaggggggaagaaacttcctgagaaagaagcactggagcttgcgtaccagtccatcagccagggtgcaagaggagttgatatgggaagaaatatcttccagagtgaaaaccctgtggagatgagcgcagctgtccgcaggatcgtgcacgaaggttttactgcgaaggaagcttatgagttttatcaggacatgattcatcaataaatgcagaggtatagttaaaaaggatagttaatagtgcgtcttgaaacggtataagccgaaagccggaataagacgcactttttttgcgcatagcagtttagaagggacagggcttttccatatttatcaaataactcatatgaaatgcctcttttataacctatgtttatagtttcaattccaatcttatatagtcttttcccgaaaattattttattttagttgaaaaatcccgataaatgttctattatgagaagaaatatattatcgaaagcataaagcgccttcgataatcggatggacggcagtaaaaatactgccttttatcagcatagtgcagtgacatagagggagaggcagagatgaattacaatattgcagtgattcccggcgacgggatcgggcctgaaatcattggagaagcgagaaaggtccttgataaggtgggaagtgtatacggtcatgactttcagtatacagaagtattgatgggcggcatttctattgatacccatggagttcctttaacagaggaagctctcaaaacagcaaaaaacagtgattccgttctcctcggagcagtcggcggaaatgtgggaaattcaaaatggtacgatgtggcaccgaatctgagacctgaagcggggctacttgctatccgtaagggtcttaatttatttgccaatatccgtccggcctatttgtacaaagagctatctgatgcctgccctttaaaaaaggagatcattggagacggatttgacatggtcatcatgagagagctgacaggcggcctgtatttcggagagcggcacaccgaagaggtggatggtgtcatgactgccgtggatacccttgcctataatgaaaatgaaataagaagaatcgccgttaaggcctttgatattgccatgaaacgccggaaaaaagtgaccagcgtggataaggcgaatgtgctggattcctccaggctttggagaaaagtggtggaagaggtggcaaaggattatccggaagttgccctgtcccatatgctggttgataactgcgccatgcagcttgtgatgaatccgggacagtttgacgtgatcctgacggaaaacatgttcggtgatatcctgtccgatgaagccagcatgatcacaggctccattgggatgctgtcttcagccagcatgaatgaaagtaaatttggaatgtatgaaccaagccacggctctgccccggatattgcgggaaaaaatattgcaaaccccatagccaccgttctttccgcagccatgatgctccgcttttcctttgatttggaccgggaagcagcagcggtggagtcagcagtggaaaaggtgctgaaagaaggataccggacggcagacatttattcagaaggatgtaaaaaagtttcgaccgcagaaatgggagacagaattgcggaacggattaaaaaagaaaaggagtgtgcagcagatgaaaagtgattcagtaaaaaaagggatgcagcaggcgcctcaccgttccctgtttaacgcgctgggaatgacagaggaagagatggaaagacctctgatcggtattgtcagttcttataatgaaatcgtaccaggccatatgaacctggacaaaatggtggatgccgttaaaatgggagttgccatggcaggcggtaccccggtcatggttccggccattgcggtctgtgacggaattgccatgggacacattggtatgaaatactctctggtcaccagggacttaattgcggattccacggaatgccttgcaaaggcccatgcctttgatgccctggtcatggtacccaactgtgataagaatgtacccggactcttaatggcagcggcccgcattaatgtacccacagtgttcgtcagtggcggaccaatgttagctgggcgtgtgcatggccataagaccagcctttccagcatgtttgaggcggtaggagcttatactgcaggaaacatgactgaagaggatgtgagggaatatgaacagcatgcctgccccacctgcggctcttgttccggtatgtatacggccaacagcatgaactgtctgacagaggtcctgggaatgggactgaaaggtaacggaaccattccggcggtttattcggaaaggctgaaactggcaaagcatgcaggaatggctgttatggaaatgcttaagaagaatatctgtccacgtgacattatgacggaaaaagccttccgcaatgcactgaccatggatatggccctgggctgcagcaccaacagtatgctccatcttcccgccatcgcccatgatgcgggtgtggatttgaatctggagatcgcaaatgagatcagcgcaaagaccccaacctttgccatctggctccggcagggcctacttatatggaagatttaaatgaagcaggcggaatttacgctgttatgaacgagatcagcaagctgggacttctggaattagactgtatgaccgtgacaggaaaaacggttggagaaaatataaagaattgtgtaaataggaatcatgaagtgatccggcctgtggaaaatccctacagccagacaggaggcatcgccatattaaaaggaaatctggctcctgattccgcggtggtaaagcgctccgccgtagcgcctgaaatgttaaagcatgatggtccggcaagagtctttgactgtgaagaggatgcaatagatgccattaagggaggaaagatcgtggcaggagatgtggttgttatccgctacgaaggacccaaaggcggccccggcatgagagagatgctaaatccaacctcagccattgcaggcatgggacttggttccacggtggccctgatcactgacggccgtttcagcggcgcttccagaggcgcttccattgggcatgcatgtccggaagcagcggtgggaggtcccattgccctggtggaagaaggagacattatttccattgatattgacaaccacaggttggatgtaaacatatctgacgatgagatgacaagaagaaaggccaattggcagccaaggaaacctcaggtgactacaggatacttagcccgctatgcggctatggcagccccggcaagccgtggagcaattcttgaaatataaaggaaaaggagcagcctatgaaaacattgaatggagcagagattgtaatcgaatgcctgaaggaacagggggttgatactgttttcgggtatcccggcggtacgatcttaaatatatacgatgccctttataagcatcaggatgagataacccatatcctcacttcccatgaacagggggcagcccatgcggccgacggatacgcgagagccaccggcagggtaggtgtctgtctggcaacctcaggccctggggcaaccaacctggtgaccggaatcgccaccgcttttatggattcaatcccaatggtggccattacctgtaacgtggctgtaaaccttcttggacgtgacagcttccaggaggtggatatcaccggcgtgaccatgcctattaccaaatacaatttcattgttaaagatataacaaaactggcggataccatccgccgggcattccagatcgcacagactggaaggcctggccctgtgctggtggatatcacaaaggatgtgaccgcagcaaactatgactatgaatatgtaactccggagcccatcaaaaggcaggaggataccataacagaggaagatttggaaaatgccctgcagctgatccggaaatcccagaaaccgtatattttcgtaggaggaggcgcagttgcagccaatgcttcagaagagctttcttcttttgcccacaagatccaggcccctgttgcggacagtctgatgggaaagggggcctttaacggaaccgacgaattatataccggaatggtgggaatgcacgggaccaagacctcaaatttcggaatcacggaatgcgacttattgatcgttgtgggggcccggttcagtgaccgggtgacaggtaatgccgccaagtttgccagaaaggcgaagatccttcaatttgatgtggatccggcggaaatcaataagaacgtcaagacttatgccagcgtgatcggcgatgtaaaagtgatcttaaagaagctgaatgcacggttagatcctatcaaccatgaagaatggctggcccacattgaccgcttaaaggatatgtatcccatgcgctttgacaagagtatcctgaccggcccctatattatagaaaagatttatgaggttacccagggagatgccatcatcacgacggaggtaggccagcatcagatgtgggctgcccagttctatcaatataaataccccagaagcttcatttcctccggcggccttggaaccatgggctacggtctgggagcttcccttggagcaaagctgggctgcaaggataaggcagtcattaacgtggcaggagacgggtgtttccgcatgaatatgaatgagatcgccacagctacccgctacaatattcccatcattcaggtggttttaaacaaccaggtactgggcatggtccgccagtggcagaccctgttctatggaaagcggtattcacatacagtacttaatgaccaggtagattttgtaaaagtagcggaggggctgggagccaaggcttaccgggtgaccggtaaggatgagtttgagcctgctctcagagaagccattgagttaaacgttcctgttgttatagaatgtcagatccattgtgatgacaaggtattccccatggtatctccgggagcgccgattcaggatgcgtttgacgcggaagacttaaagttttagataaaagtatgaggaggaagagatatgagcagagtgtacaatttttccgcagggccagccgtgctgccggaagatgtcttaagagaagccgcggaagagatgttggattacaggggctgcggtatgtccgtcatggagatgagccacaggtctaaaatgtttgagaccatcatcggcgatgctgaggcggatttaagggacttattaaagattccggacaattacaaggtgttgtttttacagggcggagcctcccagcagtttgccatggttcccatgaacttattcaagaaccgggtgggagactacattatcacgggacagtgggcaaaaaaggcataccaggaagcaaagctttacggtacggccaatgcaattgcttcaagcgctgataaaaccttcagctatattccggaggtttcggatcttcccatttctgaagatgcggattacgtttatatctgtgaaaacaacacgatttatggtacaaagttcaaaacattgcccaatacaaagggaaaaacactggtagctgatctctcctcctgtttcttatcggaacccgttgacgtttcaaagtacggcctgatttttgcaggcgcccagaaaaacgtagggcctgcaggcgtggtcattgctatcatccgggaagacttaatcacagaagatgtgcttcccggaactcctaccatgcttcgttataaaacccatgccaacgagaaatctctatacaatacgccgccggcctatgggatctacatttgcggaaaggtattccagtggctgaagaagcggggcggcttagaggccatgaaggaattcaatgaaaagaaggctgccctcctttatgattatctggatcagagtcagatgtttaccggtactgtggtaaaggaggaccgttccctgatgaatgttccttttgtcaccggaaatgaggaactggatgcattgtttgtaaaggaatcaaaggcagcaggatttgaaaacttaaagggccacaggagcgttggcggtatgcgtgccagcatctacaatgccatgccaatggaaggtgtagaaaagctggtttcctttatgaaggattttgaagaaaagcatgggaaatgacttacttggaggagaggaattatgacaaaaaaattcattgcctcaatgcggtttctaattgcggaaccgtattgctgacagacgattatacattaacaaatgacatcaatgaagcggacggagttcttgtccgaagcgcttccatgcatgaactggagcttcctgagggccttttagccattgcaagagccggagcgggggtgaataacattcccctggaggaatgtgctgcaaaagggattgtggtattcaatacgccgggagccaatgccaacggagtaaaggaactggtcatcgcaggccttatgatggcttccagggatattgtgggaggcgtccgctggtgcaaggataataaggacgatgaaaatattgcaaaatctgcagaaaaagccaaaaaggcttttgcaggctgcgagatcaggggaaagaagctgggtgttatcggccttggagccattggtacggaggtggcaaatgcctgttcttacttagggatggacgtctatggatatgatccctttatttccataaacgcggcatggaagctttccagaaacatcaagcacatcacctctgcggataccattttccaggagtgcgattacataacccttcatcttcctctggtggattccacaaagggaatggtgaataaatctgtccttgatcatatgaaggatggtgttgtgatcctgaattttgcaagagatgttctggtgaacgaagatgatatggcagaggctttacagtcaggcaaggtaagaaaatatgtgactgatttcccaaatccaaagtctgctcacatggaaggagccctagtcattcctcatttaggcgcttctacggaggaatctgaggataactgcgcaaagatggctgtagaagagatcatggattatattgacaacggcaacatccgcaattccgtaaactttcctttctgtgatatgggagtgtgcaaggcggccagccgcattgcagtgcttcacttaaatatccccaacatgatcgggcagatcacaggaaccctggcggcaggggatgtgaatatctccgacatgaccaacaagagccgtgaaaagtacgcttataccatgcttgatctggagagtgttcctgatgaagatagcatacagaagctgaaaaacatcaagggtgtggtcagggtaagaatcattaaatagagttcgggttctgccatgccattcgtcattcagcggatagaagttatttcctcaagggaaatagacaggccgctaaatgattcatgtcgggcgtccgccctatagaaacatgtataaaatttgtacgtgtgagcttgctcactaagtacaaattctatacatatttctgcatggcagaactggtaagcaagtaaagactaactattaaaagtcaagtctaaaaaagaaagtttatgaatgaattgcagaaatgcatttcaagtaaatcagtaccttgaaaaccgcatgacaaacagagcatctttacaggtgctcaaaaagaaaattattaaacagaaaagttaagagactttgttgtatgcctgtcccgatttttctaaccgataaatgactctgaccagcttcttcgcagcatgagaaacagcaacgttataatgcttaccctccgccctcttttttgcaagataggcggcaaataccggatcccacttacagacaaatttagcagcattaaaaagtgcgtagcgcagatacctggaaccacgcttttccatatgtgaatgagaagattccaactgtccggattggtaggtagagggagataatccagcataggcaagaatcttatcaggagagtcaaaacgggaaaaatcaccgatttcagctagaatcatggcgcccatccggtaactgattccaggaatcgtaagaataggggaatggagttcatccatgatacgttttatttcctgttcgatttcatcaatttcggcatctaattcacctatcagctttagggtgtgtttcagttccagagattttacaggcatattcgaaccgatagaggctctggctgtttccctgaacaggatggcgttgtctctgccgtaacgacccttagaggtttcgtaaagcagattggtcagtctggtaagatgagcagaagcaatctgaaaagcaccggggaattcgcttagtaaagcggaaatggaaggcatatgaagagtgggaaccagcttttccagttcaggaaaaagaatcgtaaccagacgggaaacagaagttttaagcttggcgcgctccctgactttatcaaaacggtaacgggttagtgactttaattcctcgttgtggtaagatatgtctgagtaggactttaagttcacatcagacataagcattgtagcaatcgtatgggaatcaactttatccgttttcgtctttctaaggcttagactttttctgaaaagactggtatgtaacggattgataacaaaggtggtcagacctttatcaagaagaaagcccaagatgttataactgtagtgtccagtggcttcaaggcctacttttacattggttaaatcatctgtagtggaagtgatcttctgatagaggacctcaaaaccttcccggttgttgggaatggtaaaggatttaaagagaatcttcccatctgagttggtgataaaacaatcatgcttatccttggaaacatcaatccctgcgtatatcatagcgaaactcctattaaatgaatttgatactgttttagaccacggtggctctctgcgattgtaaccttgttctaaataaaccgtcatgcggtatctaactgattaacaagtgaacaaagagactgtggttagagcctttactaaaccatcaagtggtaggagaaatgaactaatccacagtatctaaaacagcatagctcatacctaagaaaaggtaaagaaaagctatgactatataatacaaggagatattatggcgattgtaaaaccattcccttgcgtcagaccgggccaggggtatgcccatcaggtggcagctcttccctatgacgtgtacagccgtaaggaggcctgtcaggtaacggcagccaacccaaggtcgtttttaaacattgacaggccggaaacacagttttccgatgatgtggacatctacgatgaccgtgtatatgaaaaagccggggaaatgttaaaagactggataaaggatgggatttttgaggcagatcctctggaagcctactatatttatgaactgaccatggacggaagaaaacagaccggactggtggcctgttcctccattgatgattatgtaaacggagttattaaaaagcacgaaaatacaagagaagaaaaggaagtggaccggatccgccatgtggataccacagatgcccagacaggtcccattttcctggcttaccggtccgatgaagggatcaacgggatcgttaattctgtaacaagtactgagccattatatgactttgttgcggaagacgggatcagccacagggtatggcggatccatgaaaaaggcaaaatctccctgatccaagaggcttttcatgggattccctccacttatatagcagacggccaccacagagcggcttccgccgtgaaggtaggacttaaacggcgtgaggagaatccgggctataggggggaagaaccttttaactacttcctgtccgtgctgtttcccgacgatcagctgatgatcatgccttataaccgtgtggtaaaggatttaaacggcctttcacaagaggagttccttcataagacaggacagctctttgaagtatcctgtatgggaacagaggcctttgcacctttggaaaaagggacctttgggatgtatttaaacgggaagtggtactgtttaaaagcatttaattccttaaaatcctcagacccggtaaagggccttgatgtatccatccttcaggacaatctgctaggccctgttttggggatcaaagatcccagaacggataagagaatcgattttatcggagggatccgaggacttaaggagctggaaaaacggtgcagccaggatatggaggtagcgttttccatgtatcccacttccattgatgaattgttttccgtggcagatgcagggcttttaatgccgcccaaatctacttggtttgagccaaagctgcgcagcggattatttatccacttattataactgggaaaaacacgaaaataacgccgtccccggcaggtgaaacttatggggacggcgtttctttttcaggctcctgttttagctggtctctgcggtagacgtcatagacctctaaaagctgaggacgttttacgactcctattttttgaaaaatgttatggacatgggttttagctgttcccagggagatatataagtcctcgcttatttcctggttggttttgtccatcagaagaactcttaagatttccctttcccttgcggtcaggtggtagatctcgctgaaatgaaacagaatgctttcttcaatatcagagggaagatttccgcgggtctggcttgtcacctcttccacaatggtattattctttaataatattttcaggtaatacataagatatccggcagaaaacagggcgtacataaaatacagaatatccgaggtaaagctccggttgttcatattgatataatattttgaataagtatcaaaattaaaaattactatggtatcttccacaatgatgaggatattcatgagaacagtgatataaaaaagtcttttacaccatttaaagaaaggatcctgatattcctcaggattcttttttattatccctaagcactccgctcctatataggcgttgtaaagctggcttgggaggaaatagagccatattttccaggcgctgttgtccatggccggaacaaagagcatgaaggtcacgtatactgctaagattccataatcacggtaggtaatcgttctgtttaacagccgtttgaagatcgttaagtatcccagtgacaggatcaggtagatcatggtcttatgggtgggaacgatcataaaaatcctgttataagattctgcaaaattctcaaacatttctgacgcaaaaatcacaatatcatccactaaaattgctccgaatataatgcctatccataaaaggattttttctttcccattaaaaagaagggagaaagacatccaaaggataccagagtataccgtgatcaaaatcagattgtaaatgaatacgatttctttttccataacctgtctcctgcctattgtacgtcctcatgttgtccaacatcagtataacaaataaaaaagttttttcaactgcaaaatttcatgagaggtccattttttagtgcacaatgcataaaagtttaggagagtttatgtggattagagttaaaagtgatataaatatccacctttggttgcattctcaaccggtgctgaaactgctattttcatcttgtgaggacgcccctgaaagagcagatcacaaaaatcacagcaaagcaaaaaaggaggttttactgatggcagagaaaatagtccttgccttaggcggaaatgcgctgcagtcaggaaagggagaagcaactgccaaggcacagcttgaagtcgttcataagacttgcgagtatatagcagaattaaatgaacgaggatatgagatggccatagtacatgggaacggacctcaggtagggagaattttgctggcatctgaaactgcaaaagatgtaacaccgcctatgccgtttgatgtatgcggggcaatgtcccagggttatatcggatatcatttgcagcagggcctgaaatatgcgctcaataagaggaatcagaactttcctgttgtcaccatcgctacccagatgattgtagatgaacaggatcaggcttttcatcatccaaccaagcccatcgggcctttctataccagagaagaggctcacgctttggaagaagaaaagggatacgttatgaaagaagatgccggccggggataccgcagagtggttgcatctccgattcctaaaaagattgtggagattgaggcggtaaaggagttatggccaaaggcaattgtcatcacctgcggaggaggcggaattccggtcattgaagacgcagccggtgccctccatggaacggcagcagtgattgataaggattttgcagcagagcttctggcagaacaggtggaagcagatatcctgctgattttgacggaagtggaaaaggtggcagtcaattacaagaaaccggatcagaagaatctggatcatctaagccttatggaagcaaaacggtattgtgaggaaggacagtttgctccgggaagcatgcttccaaaggttcaggcagccatgaagtttgtaaggtccgatccttcaaaacgtgcgatcatcacctcccttgacaatgcggtagaagcgctggacggaaggacaggaaccatattcacttttaactgatttacaataaaaatttatataaggagactttaccatgaaagcaaacggaattacacattttattgacaccaacgatttcaccaaggagcagttattagacatcattgaactgtctctggcaattaaaagaagcattaaggcaggctataaccctccgctgttaaaaggaaaaacactgggaatgatttttcagcagtcctcaacaaggacccgtgtttcctttgaaacagctatggagcagcttggcgggcatgcccagtatttagggcctggaatgatccagcttggcggacatgaaaccatcggtgatacaggaagagtgctttcccagctgatcgatgtggtaatggccagagtggttgaacataacactgtgatggagttagccaaagcatgcaccatccctgtattaaatggtatgagtgactacaatcatccgactcaggaaatcggagacctttgtacaatcgcagagcatcttccaaggggcaaaaaactggaagactgcaaggttgttttcgtaggagacggaacccaggtatgtgcttctctcggatttatcacaacaaagcttggtatgcattttgttcattacggcccaaagaacaatcagcttttagaagagcacaagaagatcatggaagagaactgcaggatctccggcggtacatgggaagtaaccgataaccgtgacagcgtaaagggagcagatttcatttacacagatgtgtggtacggactgtatgaaaacgagactccaaaggaagagcgggttgctacatttaaggattatcaggtaaacagagatttaatgtctctgggcaatatcggctgcaaattcatgcactgcctgccagctaccagaggggaagacgtgactgatgaggttcttgacagcgacagctccattgcgttcttagaggcaggaaaccgcttaacagcaatgagaggtctgcttgtttatctgacacagtatcagagagagcaggcgccaagcccgcttaaagttgcagcagctaaggaacagttggagaaattcatggacgatagaaatatcagatagggggagaattatgtctgatgcgccaaagaagaaatttcggttaattgatgccataatgacggtaatatgcgttgtatttgtggcagaagcagcaagtccggtggcagcaattggtaattcccagtatttctggtggattttcctcttaatagcatttttgctgccatatggcttgatctcctcagaattagggacaacctatgagggtgacggtggattatatgactgggtgtcaaaagcatttggtaaaaaatggggaggaagggtgtcctggtactactggatcaactttccgctttggatggcttctttggcgcttatgttccctgaggtcattaatctcttgacaggaggagaactgggatttttcccgtccttgatcatagagcttacctttgtatggatcattgtttttatcagctttttttcggtttgtgacagtgcctggatattaaacggagctgcagtcattaagattctcatagcagtgattctgggatgtcttggcatctatggtgcgcttactcatggagttgcaaatgaatataccctggcttccttgattccaaactttaatttaaacagcttatcctacatatcggttatattatttaactgccttggatttgaagttgtttgtacctttgcagatgatatggaaaaccccaagaagcagattccccaggccattatagcaggcgggattgtcattgctgctatctatatctttatggcattcggaatcggagttgcaattccggccgaccagatcagcaccagtaccgggctggttgcaagtgtccagcttttgaccggcagcaccagaggaatcatcgtaacagtggttgccattggttttctgctcacactttttggaaatatggtttcctggtcactgggggtgaacaatgtggcggcctattcggcagaaaatggggatatgccggcggtatttaagataagaagcaagaagaatgatatgcccattggcgccgccattatgaatggaatcgtagccagcacggttttgatcatcgctccgctcatacccaatcaggatttgttctggtgcttcttcgcgttgaatctggtcatgtttctgctttcctatattcctgtatttccggcctttttaaagctcagggagatagatccggatacagaacggccctttaaggttccgggaagcaatggctttttaagggttctggcattcgtcccaatgaccctgatcatcgttgcgctggtctttaccgcagttccattaagctttgatccggagaccctggcgggagtccttcccatcaccatcggagcagtgatattcctcatacttggtgagctgatcgtaaacagaaaaagagaaaaataagaaagagaagggataaattatggcaaagagaattgaaaatacaactccaaagcaggacggataccgtatgcctgcagagtttgaagagcaggaacagatttggatgctatggccggaaaggccggataactggagaaacggtgcaaagcctgcacagtctgtatttacccaggttgcgaaggcaatccttcagtttgagcctgttaccgtatgcgtttctccggcacagtaccagaactgccgtgctcatcttcccgctgaaataagagtggttgaaatgaccagcaatgactcctggatccgtgactgcggacctacctttgttatcaatgataacggtggaatcaggggctgtgactggacctttaatgcatggggcggcctggtagacggactttatttcccctgggatcaggatgatcttgtggctcataaggtatgtgagatagaagacattgattcctaccgtacggaaggctttgttctggaaggaggttccttccatgtagatggagaaggaacagtgatcaccacggaaatgtgcctgttaagtgaaggaagaaatcctcatatgacaaaagaagagatcgaagagatgctggatgaatacttaaactgccagaaggtcatctggattaaggatggcattgatcctaacgagaccaacggacatgttgacgatgttgcacagtatgtaagaccgggtgaagttgcctgcatctggacggaagataaagataatcctttttatagagaagctcaggaagcctataggacattatcagaggcagtggacgcaaagggccgtaaattaaaggtacataaactctgcctgactaagaaaccggttctgctccatggtgcagaggcaattgatatggtagaaggaactcttccaagagaggatggggaggtttccatcgcttcctatatgaatttccttgtagtaaacgggggggtgatcgtacctcagtatggcgatgaaaacgatgcattggccttacagcagatccaggaaatgtatccggaccgcaaagtggttggggtacgcactgaagaggttgcatttggcggcggaaatatccactgcattacccagcagcagccaaaagcaaaataaagcgttaccacaaatctcctcaaatgtatataagggctgttgcacttgccgcaacagcccttttgctgtggaatgatcaattttcttccttgggaggctccggcggaacgaaattgtcagggattccaggatccctcatgtcatacacccggttatactcctttgtttcctggtttttaagcgtctgggaacggttcatggaaaggaatttagtgagctcatagcagctcacccagatctcattgtttccctctttctgggactcgtcaaaaatcagctgaagcccaaagtgaagatgaggctcattgatattgttggtattttcattccggctgtatccggtacgccccagatagccgatcacatctccggccgtgacaatgctgccctggcttaaggatttatgataaggataattttttcttaaatgagcgtaatagtaataccgttttccatcaaagctgcggatccccaaacgccatccgccgtactggttccagccgatggcctctacatagccgctttccaccgcaattacgggagttcccacctgacccatcatatcatgccccagatgctgccttctgtagccataagagcgggcaactccaaaatcgtcgaaatcattatagggaaaccccttggcaatgggggaaaaccctttcaacccatacttttttacccatacccggtccggatccaggctgccgtcaggaaggagggcaggagtagcataaaggggagcattttcagaggagatctgaatttcatactgtcccacaaggccatccaatacagctccataggcctctctgtaataggagtaatgagtcatttttgcagtcagttcttccatagtcttaccggaaagaagctgttcagccagcccatccaagtctttggtggaatatctggaaaagtcccctccgtacttggccccaagataagccagcagctccacccagtttaaatgaggctcagactggcaggtgttgacatcataccggaaggcttcctgcatggcctttgcagtcacgtcaaaatccacccatttaataaacttttttgcttcagagggactggcgtttttgtcctgattagctaccggaaatgagaacttcccgcctggggatacgaaaaataaggagaccagaagaaatgtcaaaatgataacttctatgtaaatgatgatatgatgtctggacacatgggaaaatctgatatcttttttaaataggttcataaacgttctccttgtcattccatggcatgatttaattcataaaggcaagccaggcccggtctgaatcagtaaatcagccgttcgatgagccgccaggtgagtcgaactccctaattaatacatatgaaaaaggaaagcaggtgtctaaggctttcccttataagatatgcaaaaggagtcaaaaatatgaagaaaaatgtaggagagagtctgtattggaaataagaaatgttcatggtataattcatcttaagaataaaaatgatgcggaacagaaagatcagaccgcagcggaaagtgaggctaggaatgaataattttgaatattgtgtacccacaagagtgatatttggccgtgatacccataagaaggcaggtgccatcatttcagaatatggatttcgtaagatcatgattcattatggggatgcagcgtaaagaaaagcggacttcttggactggtggaggagtccttaaaggaacacgggattgaatacgtactttttggaggcgtgcagccaaatccggtcttgtccctggcaaaggaaggaatggaactatgcagaaaggaacatgtggagtttatcctggcagtgggagggggaagtgtcattgactcggccaagtgcattgctgacggagcgcctaatcctgaaattgacccttggaaattctttttaaaggaagtagttccggcaaaagcccttccccacggcaacatcctcaccctgtctgcttcaggaagtgagacaagcttatcctgtgttatcacaaatgaagaaggagatttaaaacggggattcaacagtcccacacaccggcccctgtttgccatctgcaatccggagctgacctttaccgtcaataaattccagaccggctgcggaaccgtggatatcatgatgcacactctggaacggtatctgggaggaaacacaaaggatacgcctcttacggaccggattgcagaagggcttttgacctctgttatggaagcgggagctgtggctgacaaaaatcctgaggattacggggcgcgggcaacccttatgtgggcgggaagtctctcccataatgagctgaccggtttgggaagggaattcatgatgcaggttcaccagctggagcatgagttgtccggtatgtatccggccattgcccacggcgccggattatccgccttattctgttcctgggccaggtacgtatgcgaagacgatcccatgagatttgcccagctggctgtgcgggtgatgaatgaggagatgaactttgagaaaccattaaaaacggctcttaatgggatcagcgccttggaagggtttttcaggagtattggaatgcctgtcaccctaagagagctgaatgccggaataaaagaaacagacttagaagtgcttgcggaaaaatgttccttttacggagccaggaccttacctggaatccggtcattagggaaagcagaaatggtcgatgtgtaccggctggctttttaggttttttaaggagttaactgcctgttctgatcagatcaaaacggtattaataaagctttttaccgctttattaataccgtttttattgtgatcgggcaggctgtttctttatttcagcctggattttcggacaggtttggggagtaaggccgctaatgaaagaaaatcgggacaggatgacacctgatctccgatttatattccggctttccagcttacgtttttgttatttttaaatgcagttttctatagcttatgaaatcgcgaagtctttttgtaaaacattaagacaaagcggaaataatattttgatattttctgcgaatcttctcttaacctttatagcaacccattttacatatatccgttacaactgcccgtaccttctccttttccggatccttgcaaaagggtatgaagatgcataccatggttatggcattctgaggcgggcgggtcataatgaaggaattgcagataaagcggaagttgattcccctggcttcctgaatggataccagatagggcttgtaggttgcgccccgtaattccctggtggcttcatggaagatcgccaggtctttgcagtttacatctcggtagggggtaaaattgcctgggcagcacatataagaaactcctttgccttttctattgtaatatcatatgcgcctccggggacgagcgtgagtcacttttaaaatttactttgtaacaaggtcattgaggtacttatgtaacaataatgtaatatataataattgaaatgaaaaacagtaattgacagacaaaaatataggaccttggaggtgcaattgagtacctgcaggatatactggaaggggtctgtaaagtaagataaatgttctgacataagggaaaaatataggtaaccggtagtaactattctatatttagcctgcagagtataattaaaacagaatatacatgaaattccaaaatcaacagggtaagtatcccacattatttgaggagacatgcagctgttactcaccccggcaatgctgaatgtgggcatggctttttatggctgaacaggaaatgatatggcaaaagtcagacaggagctattcattacctggtcagtgctgaaaatgcacataaaacagtaagatgtctgaagaagatctgacaaagggtggatgaatttggaatcaggaggaataagctcttctgcttctttaaggggaggtgacacaaatggagaataaagatgccattttgattgtggatgatgatccaatacttcttagaatggcagatgaaaccctgcggacagattatgctgtaagctgtgtaaaatctggaagagacgctctttctttgcttacttcagattatgtgccagatattattctgctggatatatatatgccggagttggacgggtttgatacgatggcagcgttgagggaaattgatgatgtccaggacgtccctgttgtatttatcagcggaatggacaggccggagattgaattgaaaggattgtcttttggtgcggtggattatattataaaaccgtttgtcaaggagattttactggccaggatccgcgtgcatctggaaaacggcaggaggcttcgattattgagaatgatggagaaaagcgagtacagcggatggctggatgaaaataaatttgaaagtgcggcaataggactgacagaaacggaaaaaaagatcatgcggctgatcgctctgggttataccaatcaggaaatcggtcaggaattgaattattcttataactatgtaaaaaaggtggctggtattatctatgaaaaaaaatgcgtaaataaacgcagtgacttgaagaaactgatccaatccttttaatcacttgccggagtcctgtcggggaattttcccggctttttcatgtggcagagaagatggtaactcatggtaactatgtagtaagtatttaccatgatagtcttagagcaggaaaaagaaagaaggtgatgaaatgagttggtcctttgagtatgggagcgtactgtatgggggcgtgcgtattttgcaggtgacttcggatgaagccggaggagaactggttatcaggacagattatcatgaaaagaaagaactggatattgtatacgaaggcatgtactacagccagttggatgaacaaaccgtcggacagcgcataatcatggcatctgaaattaaaatgtcccagctaaaatgggtggaataccgaaaggcagctgaccggttgtatcaggaatgcggaatcagcgacgggtttctttgggaaatgcagcatcggggcagccgcttgtttgctcatcatacggaaaatggaaaatatattgtggtggcaaaaaggctgacttttggagaagcattctggaaaaaagcagagacaccaaacaggagactcataatatgaaaaattctgaacagatgggatacttaaatatttgtatcagttacagaattatctccattacgtttttgactgttgtttatctgtttctgatacatcgccatgaaaacagcctggcagggcggcttgtgttaagcacagggatgctgtgcgcatgcatgctgggaaattttctgtataagaggatgcttttgcaggaatccccaatgatctggatcaggatcaccgtgggactggaactatttgcaaatggaatctttattttattaagcggtggtttttccagtccatatctttggtattatgttggctgcctgtttcttatgatgacattggagcgcaccatggttctggtggtccctgcgactgtatggtgtctgttgtgcgggctgatgagaggtggacagggtttgtcaaagacgatttcttatctggagttaaatgtttgtattgggattatcattgtcacaggtggttttcatgtactgcttcgttatgtgcacaggttggatcagattcatgaggaacagatggtgctgaaccagaatctgatcctggaaaaggaaaaaacagagcaggcactgaagcagattacagatttgtatgatatgtataacttgtttgccatgaccggccctgaacgcatgatagaggaactggcaaagtttcttcagaaaaccatagcccccaaagggttgattcttgcagaacttgacgaaagggaaaaggtaaaaagaaaaatcagccttcagatgaatgacaccctgtttcagaagctgttctgtaaagcggcctgcattctttccagtgaagcggatagtcttgatgtggaattggaaggacaaagctatgaaatcaaccggatcggtcaggatatccggccctttggaattcttataagaccgggggaagatatattgaaaaagccagagatcagtatactttttatcaaaggatactggaagccattttcagaaatatggacatacaggaacagttggaaaaatacatcatctccgaagagcagaacagaattgccaatgaaattcatgacacggtaatacaacggttatttgctctggtatgcggcataaaagtgctggaagagaatattggaaatcttcatacggcccaggcccggaagcaggcagatctgctgaagaattcagcggaaatgattatgaaggagctgcgggaaacaatttatgggaaacattttgaggatcatgacggacgtgcctttgtaaagaaagtcaaaaaatatatggaagaaattgagaagctttgcggtgcccaaattgatgtaaatatagatgaaaaagcggcttacatgactaccggccaaagcatcgctttgtaccgcacggtctgtgagaccgtaaacaatgccatccgccacggtaaggcaaataaggtggaggtcagtgttttattcaggaaggatgaaatatcggtagccgtaaaggataacggctctggatttgcaaaggaaaaaacagagcggctgggaggcaacggattaaagaacatataccggatggtttatttgctgaatgggcggatggccattgaatcaaaaagcggagaaggtgcaagtatttgcatttattttcccagaggaatgaataaggaggtactggaaaatgatgctcattctggatgatcatcccttatcccggcagggaattgaatcaattataaggatgatacgcccgcaggaagtaattaagcaggcgggcagtgtaaacgaagcaatcagatgtatggagcaaaatgaaatagaaatggcatttattgatgtgaacctgggaaaggaaagcggatttaatttcttggagtggctggtatgcaaaaaatatgcctgcaagaaatttttcatcacatcgtcctcatcacaaaatgactttttatatgcaagagagctgggagccgatgcgtatgttctgaaagacgcgtttattgatgaaattgtatacgcactgaaggttgtggaacggggaggaaaattttattctccggctttggtagaagtgatgaatcaggtttcggaggaagaacgtatgcttggaagcctgacccaaagagaacgggaggtcttatcgcttttgagccggggtctgagcaatgcaaaaatcagccggattctctatatttcagaaggaaccacgaaaaagcacgttaccagtatattaaacaagctggaaatgagcggcagaatggaagcagtggtttttgccagcaaaaacagctttttgtttcatcatgaacctggcaggtatgccggaaatgaagtgaaggaggatgccatgagaacaaaaaggttggctgtcatttgtaaattgctgctggtctgtatgatggctgttagcctgggatttatgggaggaacctatgcagtctggaccgattctgtaacagtggcaggaaatttaacaacaggtgtgtttgatatgttattccaggatcaggaaccgaccgttcatctggtagatgacagcggctgcataatagaaattccggatattagtatgaggtatgatctggtggatggaaaaaaaagggtacgtatttttctggaaggcagcctgccggcagaattgttggagggaaattacataagaatccaattttccatggaaaaagatcagaacagcacctttgcagatcctggaaacagggaagcagatttccagtcccctgaattccaggtatccatgaaagccaaaagcgtttctgttgttgcagacggaaacctatatgagagggcatacctgccggaggaatatgaggagccgctggtttttaatgtattcagggagatcttgagggaagaggaacagctgaatggaagcctgtatctgggattgacggaagaaagcaggagccttgttgcccagcttacagaatcccctccatctgtagaagtgaatttggaggaaccaggaaggaaaaacggtcagggggactgggggatattggcggagtatgaatgtgagattcctttttatctggatcagaggggtgcggattcaaagcatcaggaatgggaggttgagtgatatgaataaggggttgatcttattcctggctcctgcaattcttgttatgggtttttccggaatctgcgcctacgggtactggacagataagctggaggtggctgttcatgcaaacgtgctttatcctgccgaaatattggaggagacagaagaatctgagccggagacccaatgggaggaaaccggtaatgaggaggatacaagtaataagaaggaaaccggtaatgagcaggaaaccagtaatgagcaggaagaaagtatcataggaaagcagggagaacatccatgggttacagcagcagatatgagtattatgcatggatcttatttatgaccatgggacttttggagtttcttccggtaagcacaagtgcaggcctggctgcttatgtcaggccattttgctggagtgtccttattgcatgggtggtgtttatgattccaagagtttatgcgcctggacttttgcacgtccaggatatgataatggggtatgctggttcgggtgcggtcatttatctggccttgtcctttcttcttgcggcgtttttaaaggagctggcagcaactccttatgatctttctcctgcaggcattgttcataatctcatcagcattcttcctggtgttgcagcaaaagagctcattcgggagtatggattagggacggcttggagaaaacccagattccggcatgtgtttgccggggcgatcacaatttttatggcagtgcttgagatcaattacggtaaggcagccagcgtatccgatgccaaagcatggtttatcttttatgcaaaggatgtgatccctttgttttccaaaaatattctattatcaattctggtgctttacggcggcgcaagggccggtattctgtattccgggatcattcaggtatttcagcggatattcccctttctccccaaccttccctggcttgctgacagcgcaatcgggattgcgtttcctgttctttattctgtttttattcatgaacggtactgcggtatcaccggatcaaaaccttcagacagtaaagaggggctggccggttatctggccaccctgtttttttctgtaggtttttgctggttttgcgtaggagtattttctgtttatccatcagtagtcctgacaggaagcatggaacctggtatcagaccaggggatgctgttcttataagaaaagtgcaatctgaaaaggaaatgtaccaattgaaaacaggagatgtgattacatttacacgaggaggaataaccatcactcacagaatcctggagacgttatacgatgaagcaggaaacgtatcgttccggacaaaggggataacaacaaatcaccggataatgagaccgtatttccccaggatattaaagggattgtaatcggaaacgtaccaaaagcagggataccggttcttttgattaagagcggagaaaagataccagaaggagttgtggatcatgaggaggaagattattagaaagaagattcccgtggagaaaaggaccagatactttctgacagcagccggcctgtttcttgtgggaatttctctggttatgtctataaaggaatgcaatccagggaccaaaaccattgaaaaacagctgtattcatacgaagtgactgtggattcctcctaccgggttcatttgattgaaaatgagctgtataaggaagagtggctggaagagggaaccgtttatgcggagagtctgaccgattatattgaagttgttttgaaaggaaacttaacaggggcaggtaacgcagatatcagcgggacttatgaagtgaaagcggtgatagaaggataccaggccaatggcgaaagcagaaaaaaggtatatgaaaagcaatttttacttggaaagggcaaggcgtcccagaatgattcccgacaggcttccatggaggaagcctgcaggatccaattgcagccttaccgggattttgtacaatcagcggatcaaatattaggaaccggaccggcaaaagagttctatattctgtttagcggcggctttgctgttgatactgaatttggcagcgaagaaaaggaatttacccataaagtgtctatcccattgggaaatggaaccagcttgtatgagatccagaaaccgggtaaggaagtgcaggaaggcggtataaaggaaataataagggaaaaagaaccgattgatttttctgcactgtttttagcggcattccctgggggcttggggattctttttattttttgtaccattttcggggtcaggcagccgacggaagcagaaaaacgtatcacaaaattaaaaaccatactaagaaaatatgcagggagaatggtacagatcggacaaatgccggtattagacggaaaagactgcatggtaattcaggatatggagaatctgctgctggtggctgaggaactgcgccggcctgtattttacagtttggatgaaaatgggtttcccaaaggcggaatgttctgtgttacagaaggagagaacgcctttcttttccttgcagagatggaggatactactttggtagtagatcatgggaaagaaagtggtaaagaaaatgctgaacaaggatagtttttaagggcagatagtcgcaaggaaaatcatacaaaggagggattcttttggggaagattcggcttatactgtaggaaatacaaaaaggagggtaacttaatgagaaaatcaggaaagaaatcgttggcaggaggaattgtagccctgtcgttaattctcacaggaaccggatatgcttattggacggatacattgaatgtgaccaccaaggcaaccacaggagaactggatgtgacgtttgccgatctgggactgtatgcacagtatagcaatgaagttctgaatggaggctggagtattgttgacggtatcggtgattccggatttgttgacgatgattttttcaccagaggtacatcttataacaaaattgcaaaggacggcagcattgaggcttatcaggaccgttcaaaagggttgaatgaggttgaatttgatgcggaacttgttgataaggcaaaaatcaaaaaaacagtaggaccttatgtagagggacaggttgacggaagtgacaatattcttcttactgtcaaaaatatgtatccgggttatgcccaggcattccgtacggatatattaaatgttggttccattgcagcaaagctgggaaatttaaaggttgatgtcaatggccttgacggtgctgtagtcaatgaaaccaccaaggatatgctgggtatcgctctgatgatcgatcaggaagcttattcctatgatacctctgatgatggaaaggaaatttttaagctgtgttcttcctttgcaaatggaacaaacagctttcgggtaggaaaggttgacttcctccgcttatctgctttggaaaacttatctgcagatgagatcaagtcagtgattgaggcctccaatcttctttgtgcaccggacagtgacaaccggatggatttatatattgcagttgcaatggatccggatggggaaggtgtttacacaaccggaagtacagataaggccgattatgcagaagatgaggaaaaggatgccttaagtcaggacaagggtgtatccatatctgttgatctgctttgggatcagttcaatgcagggaaagatggcggaaatgggaactggctcagcaagcagaatgtaaattaataaccattcatattatgggattagctttcacgttaacaaaaggagctgccgctcccctggcccacagccagcggtgcggcagctcttttaatgtccggaaaaatttccgttgttattcaaacaggtaactggtcatggaaagtgagccaagcatacaggaatcattgaagacggtgacaaggtcatttccgtcagatgccccccaaaacatacagcagcggggcaaagtgatccaatgcggaaaatgcaagggaggaagatgcaccggcctgttgatagtgaataacattttcaaggtttcccttcaggatactgtctttgatataattgtcaaattcctctgcccaggggtagcccccattcatattccagttcactctggcaaggttatggacaatatttccgcttcccaaaatcagtacaccctgctggcgaagagcgcggagcttacgtcccatttcaaaatgaattttggcgggagccagcctgtccacactaagctgaaatacggggatatcggcatgaggatagatccgccgcaggacagaccaggagccatgatccagtccccaggtattatcaaacggaatattgtcattgagcagttcttttgtcagagcagcaaaatgtggtgaaccaggcgcattgtatgtaacctggtacagctcatccggaaaaccatacatgtcataaaccattttcggggcaggggaatccgttaccctggtacctgacgtaaaccaatgggctgaaacggaaaggatggcctgtggtctgggaatccgcgcaggaagcttttcccactgggaagaatactgattttcctcaattgcgttcatgggtgatccatgtccaataaataataccggcattttttgcatatagccacctccttgaagagtatatgaatgactttatgctgattatatcaatattttggagaaaaatccatcaaatatgggaaagtgtaaatctctctttcaatgatgtttacgagaaggggcaatgcctgccagctgtggaaatccggtagttggtcttttttttgcatgaaaggagcagcatcccccttgattctttcgattgcaggatttgctgtgttatttataaaaaacaacgaaaacatctgtattcggtgatgattttatgataagatacaccataagaagatacgatcaaaggaagtaaaaggtatgaaaaataaggggaaagcttatcgaaagctgtatttatcttatggctttatttttttaatcccaattttcatgggaattttattttatttttatgcttattatattgccaaggaacaggcggatacctctaaccgaagcttgatccagacagtgaaaaatacctgtgacagggagctggggaattatgagaatattttgacacaattggctcttaataagaacgtgcagcaattgtccgtggtgaagggggagtttcggcctgacaattcctaccagctttatacgatccagaatgaaattatggatcttaaagtaacgatcaataaaaacggagattattgcaaagatatcatggtttattttaagaactgtgacaaagtggtttcttcctttggaaacatggatttttccatgtatagtgatctttattgttttggagaggaagatagaaaatcagctgaagtcttaaaagaacatctgtcagaatatcattttcgtgatgcaatccaaatgaattccaaatggactcagggaagacctacccttcttttgacaatgaacaatttaaaaggggaatttggagaatcctctgcaatgatcgtaatctggctggatatggatgctttaaacagcagcattgaacaggcgtcctgggaatcaggtctggattggctgattataaacgagaaaaatcagatcatgaacagatcggaagattattcaggcattggaatccgatatgaccatctgaatgaggatggggatcagaaaataacgtggaatggggaaaattatattatacgcactgtattttcccgtgtatttaattggaaatatgttctgctcatgcctgagagaatgataagcggctcagcagggaaaatgcagaatattttcgtgattggcatatttatctgtctgtttaccggttattgggcggcatccaggatgatgaaaattaactacaatcccttaaaggttctgatggaggtgttccggaaacacgacgatacccaggaagtatttgttgacaatgaatatttgtatctggagaaaaaggctatttcactgctggcagaacggtcagattttaagcagatggtgagcaggagccaggaagtggtaaaacagtattatttaacggatctgatgataaactcctatgaacaaagtaaagaaacaccggatcgtgaagcaattatcaggagattccgggaagaaagcaaccttgtactgcttttcacagtaaagggcacttccatgcgggagggaagccaggcagaatacatacaaattaacagtctgagaaaattcattattggaaatgtatttggagaaggaattgcaggcagcttttcttatgaaaaggtggagctgggtgataccgttgcaatgattgtcaatatacctgacactgctgccggatatgatgagagtctggaggaaatcatagatgcaatgcagaaatatatttatgagaattttggatttatgacggtggtattggcgggagaagctcataggggactggagggaattcatttatcttatatggaagcaagagaagcagaggaatttgtgactgttctggatcctgaatatatcagttatcgggaaattaaaaacagttcccataaaaaatacgattatccaacggaccaggaactgcgaatcattgcagcgatcaaaaaccgtaacagcgttttggcttcttcctatatcaataaaattctggatgccaattatctggaaaataaagcatctctggatatgttaaaatgccttctctatgatttaatgggaaccattatgaaaggagcccaggaaacaggggaaatttccggtgatgatttaggattaaagggtatttctgtaaaaatgcctcttgagaaaatcaaggaaacatttggggaagcaattgagaaattgtgtaagtcttctggaaattccagagaatacggacagaaccaacaattgtgtgaaaagattcaaaagtatattcaggagaatttcagtgatcctgatttaaatatttctcagacaggactgcatttccatatgactcctgcttatctttcctccatttataaaaaacacacaggcgaaagcctcttaaaggccatcaatcagaaacggaccgatgaggctgagaaattgctggcagagggaattaacgtggttgaggtagctgagagagtaggctttcgggactgctccacatttatcagaactttcaagaaatttacgggagcaacgcctgggcaattaaaaagcgggcggtagggattcgataaattgtaaataaattttagttttagtcaagaaaggttgatgaaatcgtgcgattttgtcaacctttttaaatatttgaatatataaaatgcccattgaaccatgtagaatgtaaaaagcaaatgcaatgcgaataaaaagaaggaggaagatttatgaggaaatgttttagaaaaccggttgctgtattggcagccatggcgactgttgcctctctgctggcaggatgcggaagcaaaacagggggacttcaagtacaggcggggagacaaaggaaacatcaaaagctgcagaaggcagttctaatgccaatgcaggaggtgaggtgtcttatcccctggctgacggaggggagcttacctattggcttcagctgaataccaacgcatcagctaactttactaatttaggtgaaacggaattaggaaaggctttacaggagcagactggtattacaatcaagttccagcatcctgcggcaggcgcagaccaggcaaaggaacagtttaatttgattgttgctgacggaaatcttcctgatattatggaatggcaatgggtaaaaatgtatccgggcggtccggaaaaagcgatcaaggatggagtgatcattcctttaaatgatattattgaccagtattgtcccaatcttaaaaaatatctgacagaaaaccctgatgtagataagatgatcaagacagatgacgggaactattttgcattcccattcattcgcggcgaagataagctgcgttatacggtaggtgggttcattcgtaaggattggcttgatgaactggggcttgaggtgccgaaaaccgttgatgagtggcataccgtattgactgcatttaaggaaaagaagggcactgaggctcctatcagctttgactgggccaatttcaaacagtccaatccaattgcatttgcctataaggtcggcgctgctaactccacatggtttatattggatgatgggggaaaggtcgcttttgcaccagctcaggctgaatataaggattatttaatgacaatgaaccagtggtatcaggagggactgatcgataaggatattgcaacccttaatggtgatcaggtaacggcaaagatgaccagtgataaatcaggtgcttccgtaggctgggcagcaagccgtatgcaggtgtttatgacaagtgcacagaagaccaatcctgattatctgctggttcccacaccaattccaactttagaaaagggggccgcacctgaatacggatatatggaaaataagttccctgatgtggcagcagccattacctccagctgtaaaaatgtagaactggcagccaggttattggattacggttattctgatgcagggcacaatttgtttaactatggcattgaaggtgtttcttatgagatgaaggatggaaaagccgtttattcggatttggttatgaataatccggacggctggcctctggcacagtccttgtcaaaatacatacgtgcgaattataatggaccatttgtacaggatttaaactatcttgagcagtatttacagcttcccactgttaaggattgtccaagtgtatgggaagttccaaatgcaggcaaacatactgttcccaacatcactccaacccaggaggagtccaaggaactggccactattacaaatgagcttaatacttatgtagatgaaatgacccttaaattcatctttggtacagaaagctttgataaatgggatcattatatccagactttaaaggatatgaaactggaccgtgcacttgagattgagaacgcagctttagcgcgttatgaagccagataatttggttgattttcaattcaagcggatattcgcaatccgcaaatacggccgggcgattgcatagtcagtccccggctgttttcggatcaaagttttcgggtcaggtattcagatgaaaggaagggatggaaggaatgaggggaaattcgttaagctataggatcaggaaagatttacagagaaactggactttatatctgctggtgcttcctgtccttattttttatgctgtttttatgtataaacctatgtatggtgcaatgattgcatttaaagattttactcctgccaagggagtctttggcagtgaatgggtggggtttgaaaacttcaccagattttttacaagtccttattttggaaggcttttgaaaaacacgctgctgttaagtatttatagtattatttttgggttcccggctcctattattctggcccttttgctgaatgaagtgaaaaacggaaagtttaagaaggtttcccagacaattacctatttgccccattttatttcgctggtagttgcctgcggtatgatcaaggacttctgtctgacgaccggtctttttaatgatattatcgcgctgtttggaggaacgcggaatcctcttcttcaggatcctgcaaatttccgtacaatatatacagcttccagtatctggcaggagatcggctggggatcgattatttatctttcggctttatccggtgtagacagccagctatatgaagctgcatccattgatggtgcaggaaaatggaaacagcttctcaacgtaaccttgcctggaatagcacctactattatcatcatgctgatcttaagaatgggttctctgatgagcatgggatatgaaaagacgattctcttatataatccgtctacttatgatactgcagatattatttcttcctatgtataccgtgcaggtctgattgaacaggattggagttattcgactgcaattggtctgtttaattctgtgatcaactgtgttctgttgtatgttaccaataaaatctctaaaaagacaacggaaaacagcctgtggtaaaggaggagaaagatgaaagttaaaatttcccgcggagagagaatatttcatgttattaattatattgttttgaccatcattgcattgatctgcttatatcccatgtggtttgtggctatggcttccttcagcaacagcagccggctgatgtcgcattcgggatttttattaaagcctttgggctttaatcttcaggcatatatgaaggtatttgaaaaccctatgattttgaagggttatgtaaataccctgtttattttggtagcaggtgttgccctggatttggtaatgacttcgctggccgcttatttcttttccagaaagggtgtgatgtttaaaaagcctttgatgctgtttgtgctgtttactatgtttttctcaggaggtatgatcccgttttatctgaatttaaaggatttgcatttgatcaacagcagatggggactcatcattccttttatgatcaatacttataatatgattattctaagaacatcctttgaatccattcctgacagcttaacagaagcagccagaattgacggggccggtcatattaccattctgtttaaaatcatcttgcccctgtctaaagcaattatggcggttatggttttatattacggcgtttccatatggaatgcatggttctgggcgtctgcgattttaagagaccgggaattatatcccctccaggttattttaagggaaatcctcatatccaatgatttacaggcgatgaacggaggcgcgggagctgatgcggaggctattgcacagagcattaagtatgccacgatcatggtggctactgttccgattctgttcgtatatccatttttacagaaatactttacaaagggagttatgattggagctgtgaaggaataaagaaaacaaatatttgacggtgtgaggaggaacggtatatgcaaacaatagaagagctgttacaacacaaggaaatagatgatggaatgctggaagctgcctatgataaggcagcagaactgattaaaaaagcgacggagcagtttacggaacaatttcctcaggaagccagtgtgaataatttttaccagaagggaaccaactacgaatggacacctggcttctggaccggtgaagtatggctggcttatgagaaaacaggggatgaagttttacgaaatacagctgaaattgaagtaaaggatttttacagaagaatcagggaaaaggaaggtgtggaccaccatgacatgggatttttatattgtccctcctgtgtggctgcatacaaacttacaggaaatataacaggtaaggaagctgccattatggcagcagataatctgatgacaagatttaatgaaaaaggtcagttttttcaggcctggggaaagcttggggaagagaacaattaccgtttgattatagactgtctgcttaatatgcctctgcttttctgggcaggtgaggtgaccggagaggaaaactacataaaaaaagcggaagcgcatattaaaacagcaatgaaaaatattattagggaagatcattccacttatcatacctttttctttgatattgaaacaggagagcctaaaaagggagtcactcaccagggctatcgggatggttctgcctgggcaagagggcaggcatggggaatttacggaactgcacttgcttataaatttcttagagatgaggaatatgctgatattttctgcaaaataacggattattttctggagcatttgcctgaggatatggttccttactgggattttgacttcagtgacggaagtgatgagccgagggattcttctgcagcggcaattgcagcctgcggtatgcttgaaatgagcaaatttcttccaaaggaaaaaacagaatattatacagggatggcgaaaaggcttttgtatgcactgatcagggaatgtgcggtgacggatccggctgtatccaacggacttctgctccatgggacctatgcaaaaagttctccatataacacatgcccaaaccacggagttgatgagtgcgtactttggggcgactacttttatatggaggcattgacccggctttcaacagattgggagccatactggtattaatggagaataggaaatgacaatcggacaatattttgacagaccggatactcattattttgtacctgatccggagaattcagcctgttactgcaaagaacactggaaggaagatgtagagcatattttacggattgcagatgaggtatgtgaaaatacatttctgtttgatttaaactgggatatggaacgtacctatgagcctgtggtattttccggggaaattgactggggttatatgccttccggtgatccggaatttgtctggcagtttaacagacaccgtttttttatttgtctggggcaggcctggcagctgaccggagaagaaaaatatgtaacatgctttttgcggctgactgatgactggatgggaagggttttgctggaggataagacagagatgggaccgtggcgcctgttggagacaggactgcggggggagacctggacgaaagcgatccgatattttaaagacagcagcttaattacagaggactttttagacaggtttgcaggatcactgcggcttcatggaaaaaggctggtggaaaagggcggagacgaaagactgcagagcaattggtgtattctggagaacagcgggctttttgagattgcaatgggacttcctcaaaacgatgaaacaagggagtgggcttccattgctttggagcgaatttataagtcaattaaggtacagatttataaagacggcagccagtgggagcaatcccctatgtatcacaatgaagtatatcactgtctgtgctgtgtaatttttcttgcaagagccaatgggatattattggagccggaattagaggaaactgtccattccatggcaatggcaaatgttatctggaaaaaaccaaacggtcatcaattcactcatggagattctgatgacacggatttacgggataagatcaccatgggagcctggttattccaggatcctgtcttaaaatggtgcggttttaagcttatggattatgaaggatcctgggatttcggaaggggtgcctgtgctggttatgcccttcttcctgcaagagaaccggattttatatcagcatatctggagaacagtggaaattattatttaagggaaagctgggaaaggaatgcaaaccttcttcattttacatgcggtgcaatgagtacaggtcattgccatggggataaaatgcatgtggatctagtgatcaatggagaagatgtgctggttgacggcggcagagcgacttatatgaacgttccgcttcgttttactttaaaggataatccgggccataataccacgacggtagatggggaatcctttactgcgtttaaagattcctggtatacggataagctttctctgcctgtaaacagaacatacagggccggggagactgcagaatttgtgcagggaggtcatcttggattcataaaaaagggtatctttgtgaatcggcgcattatctggattaaaccagatatttatctgatcaacgatcagttttatggagaaggagtacatgaatacaggcagtatttccattttgcaccggaaggagaggttttcacagaaacaaatctggtgactttccggggaaaagagaccagtgtatttctgaattttttaacaaaagatgccgtacttgaaaaaaacagggggtgacctcaagacattacaatcagtgggaagaaaatgatacagttaccgcagttttgaaaaaggaagggtttgccagtatgattacagtcataaatggagggagttcttctggggcagaacctgctgaagtgaagtttgtggatacaaccagtcacacccttcataaaccactggaagaaagcgaagcccagtcagtaaaaatcactgtgggaaaacgaagctatgttgtaattctctgcaatgatgaggtcttccatacttcagatgcagtgattgcagatgaatgctttgctgtggggaatgtctgtgtttttaacgtcagtgacaggaaaaaaggggaaaggctttatgcaggggaagtactccatgtataaataaactggataatcggaagtgtgggaaaagcataaaaatgaagctgttgctccggcagatcatgaaatctgccggagcaacaacccccttttgtaaaaaattatttgcagaactgagaaattaaatctaataaatcgcttaagttacatgagctgaaatcaaaaaacatatacgtaacctcctcatttatttactttttttggaacaagatcattgtaacacttatgtaacagaaatgtaatatataataaatggaatcaaaagcagtaattggcagattaaacggagtggatttgcagggggaaccggtcagtgatcaggctaatgtattataaatgcttgtatatttgaaagcttgatgttgatagttgacaggatatatagtattctgttcataaagattaattgtaaatgggaagggagaatttaattggatatcaataatacagatcaattacctgaacagtatatttggaaggacgctgttggtttgattacaaagtctttgggggaggccgcgggaagtcaaaagatttatgtgaatattgactatgttccacccagggcatacagcacaaaatatcacagtcactcacagcaggaagagttttttatgatcctctccggaacaggaactttacgtattaatgaggaggagaagactgttaaccagggagatttcatagcaaaaccggcaggggaaaatatcgcccacacattttataattccggcggtgagaccctggttattctggacattgggacgaatgaaaaggaagatacttgttattatcctgatgatgatatgtatatgcagaaatctaatgggtcaaggcggatatttaaaggaacggatctggatacttcatggcttccggagccgaatccgaaaggctgaggtttagcctggatctgaaaagctgaattggggataagctggaaaggaaggagtaaaaatgatcacaatattcaatcgaaaagaattgataatgacttttgagatgaaaaagcaggctgaggttcgggaactgttggcccggaatcatattccttattccatcagggtgatcaacagaaaaagcccctccctttttggtgcaggttccagggcacgaaccgggacgtttggggaaaacctgcagctggagtatgaatatactatttttgtcaaaaaggcagattatgaaaaggcaaatgccattttgaacggaaaaatcaagtgattaaaccgcttaaaaagattaccagtgtttgtgatccaacaatgataatataattctggactgaaagggcaaaggtcttttccttgatctgttcctttttaaagcggcggatatttttatgaacaggaataaaggtgagcagtgccgccaggcagaccggagacaaaagcttcatcgctacagacgccgcccatgtcaaataagtaacatagtatagcccggcaaaaacaaacagcgcttttttgcctaaaaaataagaaagggtataccgccttactgcaatatccttttccagatcgcagatattgttcgccagcataatgttggctgtggcgcagattggacctgctgaaaacaaaagcaggaaaaacgcgggcgcaaggtttagattcaattgaattgtatgccaatccaccgtcaaagtcacaaaggttccggacggcatgttcatgtaaagcatcagaaaaggaatgaacagaccataaaacagccctgaaaaaatctctcccaggggtaaacgggaaatgggaaccggcccccaggtgtagaacacgccgcagagaaagcacaacccgcccagcagcaggacgacaagatccgtacggtacgccagggtaaggcctaaaacagtgcttacgccaaacagcagataaatgatgtgttttgccatgctcctgggaaaaggaagcttctggccgttggttttggtgtcaatatagttattgatcgcggtcgtagtcaggtcgaacagaaacatggagccaaaaaacagaagtgtgcgctctgcatttaccggctgcctgcggtaaaacaggtaagccagagacatgagaaacggaagcaggcttgtaattttagtgcgtatttcaacaaattcaagaaatttttttacattggaatgttggttcacttccatagtttttgtttgcataactttcctctttcatttattcatttaaacgggtatggtgagagcgttcttacctcaacagacagtttccggagcagctatttttataaaaagtcaaaaaattatcctacccaatacaaaagaaattatgtccggatagggtagaccttgattcaatcgtggatacagttgtgcttgacaatattataacaatgctggcaggaatagtcaaattcattttccaattcaaaaacagatccgcgtttttcaatatacgaaaaatacggacctgtttttgaactatctgttttttaataggaaaaacacatttaataatgatcctttcttaaaatatgtttgcaccccatataagtcagtccaaaatatacgccgtaaatgacaacaataaataatgccggaattagaacggtatccatcacattcacacgccccaaggccttcattacatcatttacagccgtaagcccaacaatggaatgagcaatgccaagtataaagggcagtaaaaaataacagagtatttgtacaaacaatgcattgtccagcattttcttttcggcacccagcttccttaacagcgcataacgttccttgttatccgctgcctgggcaagctgctgtattgcaaggatcgctgcgcaggcaaccataaacacaatgccaagataaatggctaaaaaggatatgatggctttcatggcaatggatgaggcatagatatcttctctgcttgaatagtaccaaaagctcctttcctggtaatcctcactgttactatactcatttaatttttcctgcagctcctttgatccttccccaaatctgcataccatgttaagtacatgatccggcgactgatcaagaatttcagcaaacgcgtcatttacaacgaatgtgataccggaatcactgttggaaagttttatgttttgtacctccccctttgactggagtgttttatccccaagagaaattgttacttttttgtcaaggaattgctgtgcaatatcctggtaaatgtcaccggaagcaatgatgaaatactcatttccaggaagatcgtttttttctttttcctgcatttctaaaaacttctggtaatcagaaaacataacaaaatcaagtacacgcttccctaaatcaaaagacagggaagaatattctatggggaaatccttgtaacgaaggtccccgcggtaaatgctgtattcatggcttatggcatcaatgcttttgattgacaaaggcaggctttcgtatatggttccatgacttccctcctcattacttccataaaagctgacatcatagggagctgtcttctttaaatcggctgacagaatatttttcatgctgtaaccggttgaaaaaataccgattaccaaaagcagcacaatgcttatcacggatatggatataaaatttgtgttgatcttactggtgagctggcgggttacaaacatggtcaggtttttataatacagctttttatttgattgtaccagcttggtcagtattcctgaaagagaaaagaaaaacagtaacgaaccaaccgttcctaaaacaatggaacagaggaagatctgattgatgttaatgattccatttttcaaaaccaatacatatgcggttcctaagaaaataatggatatcaggaaaatcagtacagataatctggtgctcctgatttttaagctttcatttttccggcctccataaattaaatcaatcagtttataattgctgatagcaattgtattaaaaataatcactgtcaaaaaaataactgcgaaataaaagatactttttaccgctgcatctggagaaaatatgaatttataagctgtcatatccgcctcaaatattttggcagtgaacacagacataaactgggagccaaaaacaccggttaccagacctgcaattaaagcaaggaggcccatgagaaatgtttcaagtacaagaatggcagaaattttgcctttactcatccccagagtcatgtaaatccccatttctttttttcgccgcctgataaaaaaactatttgcataaatgatcaaaaagcccaggatcaccgcaacgaatacggatatgaccgataatatcttcttaagggcgatcatggaatcgctgactatttccgtcaccaccatgatgtcctgctgcgcgtagatggagttgaacatatagaaaatagaaacaccaaacacaagagtaaaaaaatataccgtgtagtcctgcatgctttttccgacatttttaaatacaagcttagtcagcacttaaatcacctccaagaagggccataacctccataatccggtcaaagaattccttacgtgattcctctccccggataagctcattaaacagcctgccgtctttgatgaacaagatgcgtctgcaatagctggcagtaaaagcatcatgggttaccatcagaatggcagcatgaatctgttcgtttaggtttttaaagctttccagaagcatctttgcagacttggagtccaaggccccggtaggttcatcagctagaatcaggctgggatttgtaatgatggctcttgctgcggccacacgctgcttttgaccgcctgacatctgatacggatacttattcaatacctccgtgatgtttaaaagagaggcagcctggtggatccgctcatccatatcctctgcaggagctttcataattgccaaagccagggcaatattttcatgggcagtgagggtatcaagcaggttaaagtcctgaaaaataaagccaagcttttcacgtctgaactttgataaggcctctgctttcatctcagtgacatcagttccgtcaatatagatatgcccggaagtcgcatcatcaatggtggaaacgcaattgagaatggtagtctttccgctgcctgatgcccccatgatcccgatatattctccttctgaaacattaaagctgatattgtcaacagcctttgttacattccctttgttaccgtaatatttctgaaggttctgaacctttaagattgtattcatggtgtccatcctctcctctaatatttagaaataatataggctaaaatcgtaaaaatataaatatgggccggataaaaagcataaaagaaatatttcattccacggcccttctgcttattgtaaagcagcataattggtaaggcaaataccatacaccactgaatattatgcaaaaacatgctctccacaccgacctcggggttataacccattgcaaagaccaaaaggctgagcagaaaataaaatatacctattttctttttatcctggttgcataaatataatccaacgcctaaagcaaccagtacaatgccgccttcacagaataagagggagggaacaaagagcatgattcctcttgttataataaataatccgggatcagacatggctgataataggataatactgctgaaaacaggaataagcattaaaattatatactggagaaacggacggttctctttcctgcatatggaaatccgctgaatactgaaaataatcaggcatatgataaataacgtagaaaaaatattatttatgataattccaccattaggcaacgggaagtaactgttaatcagatcattgccaaagcccataaatacagatccgatccataaacgcattaagtattttaccggatttctggtatatctcatgccattagccgtagcaaagatgaatagaggagccgatagtctgcccagtattgtaaaccacagcggaattgggaaaacacctgtaaaagcatagtgaatgtgatcgaataccataagcaccaaagctattattttaatctgaaaactattgaatcctttttgtatcatttatgatctccttttctttactaacttatatctgctacgccggaattactttataagcattgggattatatttattcggactcttaattgtccatacaagcgccttgatctgcgtgattgtcagctctaaaggctcaacaccgtaatagtgattcgccgcctgtttcagtccatagcatccttccccgtagtaagcaatattacaatagagctccagtatttcatcctttgtaagatctttttccaggtgaaaagcaacaaataattctgccaccttccgctcatatttcttttcaaaagaaaagtacatattttttgcaagctgctgggtgatcgtgctccccccttgcacaaagcttcccgcaatcacattgttaaccatggctcttgctgtagcaatgggatcaaagccaaaatgataataaaaacgtttgtcttctgattttaacacctgctctttatatccatccggtatgtcttcaaatgtaatataacttttttgttgtttaagctcctcaattctatccggcacgcttatggcttctgttgcagtcttatacatttcatatccggcagaaaccataggagatatttttacaatacccatgaggaagctgatgacagcaagtaacaacatactgataccgattgttttatttttcatcaaaattactcctttcgtggtttgcttcctcagtataccagggaacgaatcatggaaccatagattttacttacggcaaacgaacaaatttgtaagataaaagggctccgctttaaaataagcggaaccctttactgcaggaatgactgcctgtcttttggaaatgttattttaattgtagtaccatggcccatggaggactggacttctaatcccagatacatcttattgcagagttctttgcaaaggtataaaccgatccccgtggatttggcaaaagctcttccgttttctcccgtaaatcccttttcaaacactcgccccaggtctccttcagaaattccaattccattatcccgaataaaaagaatcatattttcctggttttctgaagcaaaaaaccatagggtcaaagcctcttttttatatttgatactgtttgcaatgatttgtccaataataaaatcaagccacttttcatcggcataaaccgaataatcaagatcatccagtttcactatagcaccgcaccctatgagctgttttgaatgtttctttacagcggccttcaccaggctgttaagagaaagccttctgatgctgtagtcagctgctacatttttgcttcgggcataataaagagcctgttcaatataagaatccacccgtactgtttcctcggatattctctttgtgatgtcattgcggttattccgacagataagatcgatacaggatatagggatctttatctcgtggatccatgtttcaatatattcctggtattcatcctgggatattttataggaggcaatttcatcgttcatggcttttgtaacctgcttaagaacctcacataaaacctccgcttcggcaaaatcaggatcttctaataaggaagcaatatactgcttttgatccattgacgccaaggttttatttaatcgattataatatctgctgcgtaacaggtattcgtgtgccagcgcaacaaaagatgttatgacaatggtcatgcaaataagtatcattgcatagcggctgatatgatagacatctaacagcacaactaaaaagaaaatgataaagccctgcgccaataaaaacagagttttatcttttaaaaagctggaaaacttcatatcatatacccttgcccacgtttggtctttataaagtctgctgcaccgatttcttcaagtttcttacgcagacggttgacattaacggtcagtgtattgtcatcgacgaattcgtccgactgccaaagctcatccattaattcatcacgggaaacgatgctgtttgcattttgcattaaaacagaaaggatgcgcaattcatttttagtgagctcagcctctttgctttcgtaatataccgtgctttttgccatggataatgttaagcccttatattctgcttctgataaataattcttctggttggtgcgtttgagtatggctccgatcctggcaagcaggatctgaatgttatagggctttgttataaaatcatctgcgcccaggttcatgctcatcagctcatccatatcattgttgcggcttgtcacaaccatgatcggcacatccgatatcctgcggatctcccggcatacgtgatatccgtcataataaggaagattaatatcaagcaaaatcaaatctgcgtttgaatccgttgcttctgatataatatttttaaagttatcacttgtttcacaagaataattatagctttcaagcagcgagatcaattctgttctcagaacgatatcgtcttcaatgataaatagcttcaaattaataatacctcctgccatttttctgttgtagggcttatgtattgattatatattgggggtggggggattgcaagtgaattggtgtggctgtaaaaccggtgctgcttgctattggtactaaaatggtactaaaaagtatgcggataatttgtgatgttccgtttctgcaaaaagcaatttagcaataaatattgccgatttttattttatagccatattcatataagacatactgatgtcataattcatatgatatactgattttaccaaacaatacaggagggaatgggatggaagaattttatgcaggagaaagagaaaaggtgtttagaagaatgccgactcattgcggagatgatacttgttcatcctgtgtgatagcaggagattatatttatttagctcatcacggagggggtcaggacaaggaagacattgaatatcagatgagaaaaacatttgaaagtatgcaaaatacactggcagctgctggtgcaacccttgatgacatggtaaaggtgaatttgtacttaaaaaatatagcggatttccgcaaagcagctgatgtgttcagggaatattttaagaatggcgcacctgcaagaatgacaaccacaacagagtttgtcggagagacatgtttatgccagatggacggcgtcgcatataagagggaataattattaattaggaacatgtaacaaatgatcagcatttggttcaattaattatttgaagcgtcaggttcagaaggccattatctgaagcttacaggttaatgataaagagcaatgatatagggggaacagggcgaaaatttaaccgaatcaagtaagtccccacttcaaatgcgaaaagcattaagtggtgggtggggatttgcttgtgtcaggtggagtacaagatccacctgacaggcagagacagctgctattcggttatgcccgataaagcggggcagggcctcccccacactatcggggacgccgtgagcaattagcgaagcggattgcgaatatccgcttgacatcacacaagacagtatcacctgctcaagctgcagacacttgcttaaatgctgtaatggaagcgcttatttcgtatgattattccacgcttttaagcgatgaaaccatatcaatacttttgaattttcggcccatcacataattcacaagcatggtaaacccaagaataaaggcaaagcctgccacagtgctgggcatggtaatcattggcatgatttccaagtccggcgtggttgcctgggaaagaataatacgcagcagcaaggaacccacaacatagccaaagggcaatccaaataaggtgatccaaacattttcgcgcaagaccaggcgtttcatttcctttctataaaaccctaagactttcagcgttgcaagttcgcggtttctctcgtagtagttcattcgtccaagcaccatcataacggcaaaagccagtaagccggaaaacaagattaagatcatttgaaaagattgcagcgtttccaaaacaatgagcatattgctgcgcatttcttccctggtttcaaccagggaaatcctggggtcgtctttcagcttgttaaggtcaagatcctgcccgctgatcagcaaagttctcacaagaaaaggcagatcggatactttttcaaaggcctttttgcctatataaatctcattgcccacaggaaaattcacaatgtctgccactgtaagtgtaagtaccgttccatcaagccgttcggcagcgagtttgtctccggcctccacggacagtgcctgggccattctgggagtaatcaacactccattttccggcaagtacattttgtatccttccatatctctaaaatcaaggcttttttgcccttcatccataacaacaagataaggattctgcatactgccgttttttccagacagatagacgccgaatgccattgtttcatcaacattttctgccctgtctaaaacagaataaatatcggaaagctgttccggtgccaaagaggttcgcagttttatctccacatgataccgtaccgtttcgttaaatgctttattgagcatagcatttatagaattcatcagtccaaagccgcatagaatcaaagctgttgagccgatgatgccggcaaggcccataaccatccttgctttattacgaaacaggtttcttgtgacgatttttccgctgaaactcagtctgcgccaaaagggtgaaactcgttccagcaagatacggtgaccctgagccggaggtctgggacgcattaattccgatggcatagactttaatgatttgtggcaggagagtaccgccgcaccgccagtaaccgctgccacacaaactactgacagaaaaaagtgaggtgtaaaggcctttactccggttggctctatcgagtaataggtaattcccacaccatagagaaattgtgcaatcatataccgtgcaagaacccatcctaaccccatgctggaaatggtgatcagccctccaaacagcgcatatctgcccatgatctcctctttggagaagcctaaagagcgcagcacccctaaatgctggcgctggttctccatcatgcgggaaacagtgatccaagtgacaagagccgccgtcagaaaaaaggcaatggaaaacagcagtccgatttgttttaccccggtcattgcatcagccactttacggtaacttgtctgatggtggcggctgagaatattggctccttccattacttcgtgtacctgatttgaaattttctcttgtgaaggaggggtctccttatcaacagtgaaaataacttcattataagccgaattcggaaaagaagctgcgtttgtataagcaaacccatatttgtgatagtccggaaccgtcagaccttccggcgcgtaatatacatattccgcatcccgtacaatccctttgatcagccattgcatttgcccctggctgccttcggttactatcgtatcgcccacccataagttgtgggcttctgcaaaacgggtgtcaagcaaaagagtatttgtttcatcactgtcaagaagacttccgtccagcagctccgggacattaatagctgcggcttcaccggtggcatgaatgtgcagaattgcatccgaaacgccggacaaggttaagtcagccgttttgcgccgttgggcctcctggatctgatccagagaccgtatgttattaaggtcggcatcagaaacttcggttttgtaaatccaataatcagcgagcttggagcgttcgtaatattgggaaacttctccttcaaccgtactgacatatagatgaattccgctgaagagagcaattcctagagaacagatacatacaatggcaagaaatgaccagcgattcgccccaatatcccggaagatctttttttgcagcatcgttaccatttgattccctccagatccccaggattttcctcagttgtttcccggatgactctgccatttttcatttcaatcagtcggtctgcgataggagccagcagagagttatgggtgacaatcaacactgttttccccatcttccggctgatatcggacaaaaccctgagaacagtttttcctgtttcagtatccaatgcgccggtcggctcatcacaaagaagcagatccgggtttttacagattgctctggcaatggcgacacgctgttgttcaccgccggaaagctgggcggggaaattatggattctgtccttcagccccacaatccgcaaagcttcctccggttcgagggggatttgcacacctgcctggcaagctcaacattttctgcggcagtcagatttggtatcagattataaaactgaaaaacaaacccgattttatagcgccggtaatcagtaagttccaaatcattcattgttgtgatatcattgtccgcaaaaagaatttttccggatgtagcggtatccataccgcccaataaattaagcacagtggtctttcctgcgcctgaaggtccgagcagaatgcaaagctcaccgttcttaacctgaaatgacacatcatttgctgcataaatagtgacatctcccatttgatattccttttttacgttttcaaaacgaatgtctgccattgctgatactcccttcaaattatgaactttgattatgattatagttcatatattaccgcctcttgtttgacttgtcaagcagcttgtgatatattatttacgaataaggtttatatagttcatatgttagggagggaaatcctttggacggttttgagaaaagaagaaatgataagaaaaaagccattatgcaaatggctttggaattgtttgatcaatatggattcaataaggtgacaatgacagaaattgctgataaggctcatgtgtccaaagtatccatttacaatttctttgaaagtaaggataatttacggcgtatcatcataaaaaatatgctgaatgaaagcatagagaagatcaaggatttaattgataaggatgaaagtttttccgataaaattgaagagtatatccaaatacgaacatggtattatggcaaatacagcctgcagttcttttttgaggccatagaaaacgatccggaacttgaggtatatttaagtgaatttaactccaccagcaaacagctattattggattttattgaaaagggaaagcattccggtgttttttcacagaatgtttccaatgccgctattgaaatttatattgatatgattcagacctatttgatgcacaacaaagaaatccgcaacagaatagagcgcaatcccgaattggtgagagaaatcaatatgctgtttttggatggtttaattcgggggagaaacatctagaagatcgtttttcatgctttgtttaagattagtatcaaggcagatgaggaaaaatggcagtgatataagttagatcatctggagcttgttcagaagcctcgtaatgggcatgctgaataagctctttttttgattatataaaatgatttcattgccggcatattagtttttacttcctccaaaccgtattttttttcttgtaccaatcttttgaaaatatacttttttcttattattttcttgaaatttcccttggtttgaattgatttatatcataatattaatcaatggcttaacatttacagctattcctttttatcgttgacaccccaaggtcatttccgtataatgcaagaaattgatcacctgaccaaaaaaggggagaatgcttatgaagacaactaatcgggaatcaaaagaatgcaggggcctttccaccgaagaaaggatactggatgccgcgcttgatatcattcaggaaaaaacaataggtgggctgagaatcagacaggtggcagaaaaagccgatgtggttcagtccaatatccaatattatttcatcagcaaaaaaggtcttctccttgctgtccagaaaaaagtcttaaaccgctaccgtgaaattcgtcagcattccatcagccttctaaaagccgaatcccaattgtctcttgaagatcacttaggcatcttcataaatcaaaagatatataccatccgaaaagaaaagaaatatgatgttgcagagttggatttctggaaccagtcccgtctggaacctgacatgcaccgggaattctgccgttccttcgaaagctggcgccaggaaatccgcgatatgatcagtcattatgcgccagaaatgcctcccataaaacagaagctgctttccggcattacagtctccctgctggaaggagctgcgattcagattctggcagataagcaggcgtttgatctggatttatattttgcatactgcaaggaaatcctgataaaggaaatcaaaggataggaggattccatgaaagagctgctgaaaatggaacatattaccaagcattttggtgaggtatatgcaaaccgcaatatcaatctctcggtacagggaggagaggtacatacgctgctaggcgaaaacggggccggaaaaagcaccctgatgaatattctcatcggcttataccagcccaccggcggagaaatctatctgcgcggggagaaagtaaagatcgaatctcccaaggctgccgtccggctgggaattggtatggtacatcagcactttatgctggttgaagccatgactgtctttgaaaacattattttaggcagcaaaaaagattcttctatatttattaataaggagcagctgaaaaaagatattcttgaactttccggaaaatatggcctggatgtggagctggacaagcctgttacggaaatttccgtcggagcccagcaaagggttgaaattttaaaagccctgtaccggggagcagaactgctcatcctggatgaacctacggctgcactcactgacattgaggcagagggactctttgcaattatccgaaagctgacagaagaaaacaaatctgttatctttatttcccataaaatgcgtgaagtacttgcaatcagtgaccgcatcaccatactccgggcaggagaaacagttaccactctggataaagataagacggatggaactcagctggctaatttaatgatcggccgggaaatgatcccaagccactaccggaaggttacagcctccggggctgaagtgctgaacctggagcatgtggattaccagaaacagcacaagcacagcggtttaaatggcatcagccttaccgtaaaaaagggggaggtcctgggcattgccggtgtagatgggaacggacagtcccagctggcccagctggctgcaggagttatttcaccggatgccggcaccgtaacgctgaaagcagaccggatctccaaatttgctccaaacggatttatcctttcccatgtttcccacgtacccgaggacaggaacaaaatgggcctgataggcaatatgaccgtaagggagaatctggtattaaagtcaacggaagaaaaacgtttctcttatggacgtggtgctctgttaaaaagaaagtccatcacagcctatgctcttgatatgcaggagaaaaatgacatccgctgcgcttccattgaacaggaggtccgcaatctgtcaggcggaaaccagcagaagatcattctggcaagagaactggaaaatgacccggagcttcttgtggctgtccatcccaccagaggactggatatcggagctgccagatatgttcacgacaccatgatctctgctagagacaaaggctgcggcatccttttaatcagtgcggactttgatgagatcttaaatctctccgaccggatcatcgttatgtttgaaggccaggtcatgggtgtttatgccggagccaacccgcccattgaagaaatctcactggctatggccggaaaggggaaataggacatgaaacgaagagataacctgactaaaatcattgtgccagtcatttccattctggtcgcatttgtcattggcggtattatcatcctgtgccttgggaagaaccctttccaggcatacggttacctgttctccggcgctttcgggagcagcagaaaagttgctcagacgctggtcatcgcctgtccgctgatcttcacaggtctgaccgctgctttctcctataaatgcggtgtttttaatctgggaggagaagggcagtttatcataggtgccgttgccagcatattctttgtcaccaaatcaggtatggagggaataccgggaattcttatgagccttcttatgggtatggcaagcggtgccatatggggagcaattccaggaatcctgaaaatcaccagggggttaaacgagatgatcgtcagcattatgctgaactatgtggcaacgctgttcatgggttatgtatacactaccctgctgcgggacggaagtgtccctcagacttatgccattccggacagtacgaaaattgccgttatttccaaaagttttcctgtacactggggaatcggaattgcgcttttcctggctgtcgcaggctattactttctttttcacacctccaaaggttttaagctgcgggcggtggggctgaatgcaaccgccgcattttttaacggatttcctgtaaaccggtacatccttttttcctttatcatatccggggcagtggcaggccttggcggcagtgtagagcttcacggaaagcagctccgtctgatgagcggctttggccagggatatggctttgacggcgtggcaattgcactcattgctcagttaaatcccatcggatcggcagccgtggcatttatctttgctgtcctaagaaagggagcaagcaccctgcagaccggaatgcaggtgcctaccgcaattgttgacatcattcaggcacttgtcattatatttgctgttgccggtaccgcactcctaaaattgccgtctataaaacagtaccttaacaggcagctggtaagaaaggaggaaaccgactgatggaagcttttttcaacttgaatttttttgtggaactgctgttatccacggtacgtatggcaacgcctattctgtttgtggcactggcggaaacttattccgaacgggcaggcctggttaacatcggcctggatggcatcatgtcatttggtgccctggtaggctttctcatcggtttccgtacgggaagtccaatggcaggaattgcagccggcgctttatccggaatagccatcaatatgatctatgccttttgtaccattaagctttgtgctccccagatcgtatacggtatggccctaaatatctttgctccggctctggcctcctttatttaccgcctgtctttttccgatacttccacgctgattcagggcgtatccatgaaagcagtgccgattccggtgctcagcaagattcctgttgcaggacctgtttttttcaaccatattccgctgatatatttagcttatcttctggttccggccactgctgttttcttaaaccggacaaaggccggtctgaattataaggcagtgggggaatttccaaaggcagcggagactctgggaatcaatgtaatccttcaaaaatacattgcctgcgtcatctgcggagcgcttgcaggcataggaggggcatacttaaccgtctgctataccagcacctattcggaaggaattgttgcggggcgggggttcatcgcattatccgccgttattttcggccgttggatgcctgggggcgtaatgcttgcctgcctgctctttggattctgcgatgccctgcagatccgcctgcagcttttaagcccctccaccccttaccagatccttcagatgattccttatctatgcaccctgttcgtcctggctttctttggaataaaaaagagcggtccaaaagcaaatggacagccttattaccgggaagagcgataaaagtaatttcaggattctttcctgcagttatatactatttcaaacataaaaggaggatataattatgaaaaaaactatgaaaactgcttctttgtttttggcagctgccctgacggtcatgagcctgtcggcatgcggcagttccgctgctccatcatcttctgccgagacaactacggcgggtaccactgcggccggcgcgcctgccgctgaaacaactgcagctccggctgaaaccgaaaaaaccaaggattttaaggtggccatggtcctggactcctctgtttctgacggagggtggggggcgagctgttaccaggcaatggttggcgctgccaaggaaagcagctgggaaactgtgtacaccgataatgtggcaactgcagatttcgcaacggttatgactgattatgcagagctgggctataaccttatctttgctcccggaaaccaatataccgacgcagtcaagcaggttgcagcagaatatccggaaattaaattcgctctgttaaatgggacggtagaaaccgataatattacctccatccttcctgatgcaaaacaaatcggctatatggcgggcgctttagcaggccttatgagcaaaacaggcagcatcggcttcatcggtggcatggaacttgacacaaccaaagcaaagctggaatgctacgaaaaggccgctcaaaaggtaaatccggatatcaaggtttcttctgcttacgccggctccttcagtgatacggccaaaggaaaggaaatcgcctcttccatgatttctacctatgatgttgatgtaatgtttggtgatgcatctgcagttgacaccggagcccgggaagccctggcagcttccgaaggcagatacgatatcgggcagccgggaaatttaggttcttccgacgacaaagtcatcatctgttccgtggttactgacaacgcggccctgctcaaagcctgtatgaatgatgtggaatccgattccttcggcaacaaaaccatttacggagatttaagcaacggctgtctaagtgtgggaaccttctcaaatcttgtgccggacgatattcagactcagtataaagaaatcgttgaccagatcaagtccggagactttatccagtaatgcaaaaaatcatgccggcgcctgacctgcaggtgccggcatgatcggaaggaccggtaagaatgttctttgatattggcagttctttttacaccgtgttctttcatcgctaaattcagaatcgcaggatataagaatagggagattattccctattcttattttttatcatgataaagggaaaaattctggccgccccgatccataaggaacgccttgttaaaaagggttttaaattgatatcttttatgatactatagctctatagaaatgcagcatcgcttcatgagaaggggagggtattatgagaggtttggcatatctgaaactgatggcaagggagtatcccacgattaaggctgcttccagcgagatcatcaaccttactgccattcagggattaccaaagggaacggaatattttttcagtgacctgcatggcgagtacgaggcatttgttcatttattaaaaagtgcctcaggcgttatccgcgaaaagatcacggaaaccttcagccacattataccagagaaagaagaagtggagttagcaaacttgatttactatccggagagagtcatgaatcagctggagcttaaaggccttgcagacggtgactggcagagagtgaccatttaccggctggtacagatctgcaaagtggtttcatcaaagtacaccagatccaaggtaaggaagaaaatgcccccggagtttgcctacatcattgatgagctgcttcatgtggattataatgatgacaataagcgtgtatactataacgagatcatacggtccatcattgacatccgggtgggagataagttcatcatagccttatgcgagctgatccagaatctgaccattgacagcctgcatattatcggagatattttcgaccgtggtccaagggcagatattattatggatgaactgctgcggtttcatgatgtggatatacaatggggcaatcatgacatttcctggatgggagctgccaccggaaatctggcatgtatctgcaatgtgctgaggatcgcaatcagctataacagctttgatgtgctggaggatggatacggcattaacctgcgtccattgtccatgtttgcggccagggtttaccgggatgatccctgtgaacggttcactccccagatccttgaccaaaacatatacgatgcggtggatccgggactggcggccaagatgcacaaagccattgcggtcatccagtttaaggtggagggtcagatcataaaacgccatccggaatacgagatgagtgacaggattctgatcgaagccattgattttgaacggggtgttgtaaacgtggaaggcaaggaatacccaatgcttgatatgttttttccgacgatagaccctaaggagcctttaaagctcagcaaagaggaagaagagctccttcataccctgcagctttccttcatgcataacgagcttcttcacaagcatgtccgtttcctgtactctcatggaagcatgtataaatgctataattcaaaccttttataccatggctgcattcccatgaaagaggacggttcttttgaggagatcgtagtgggaccccacgcttattctggaaaggcgctcatggattacgtggaccggaaggtccaaaatgcatattttatgcctgaggactccatggaaagcgaggatgccagggattttatgtggtatttatggtgcggagccaaatctccggtatacggcaagggaaaaatgacgacctttgagcattattttatcggagacaaggccgcccacaaggagtctatgaatccttattacaggctcagcgtgaaagaagaatactgtgataagatactggaagaattcggcctttccaaaaacggctcccatatcatcaacggccacgttccggtgaaaataaaggaaggggaatccccggtgaaggcaggcggcaagctgttccttattgatggagggctgtcaaaggcttaccagaccaagacagggatcgcaggctataccttgatttacaattccaaccatctggcgcttgcggagcacaaaccctttgaccctaataaggaaagcacgccaaaggtttccgtagttgagaatatgaagaaccgggtcatggtggctgatacggataagggcgcagagctggccgagcggatcgcggatttaatggaactggtggcggcataccgggatggcgtaatcaaggagaaagtagagtagtccaaccgattatgaaattttaagaatttattcagagaaggtttctttacgaagtccctgtcggatgatacaataatcaaagctatttacttaattgaaggaggctcagatgagcagacaggagtttttacagcgcttgagggagactttatcaggtgaagttcctgggagcgtgatcgaagaaaatatcaggtattatgaagaatacatcaccacggaagtgagaaatggttctacggaagaggcggtaatagcctctatcggcgatccaaggctgattgccaggacgattttagaagccagcgaaaatgcaaaggacagcggatcaggcagaacttactatgaatcctattccaacgcagatcaggatgtgtatgaggatccgggtaatttcggacgccatatgcattacattgacttgaataaatggtactggaagcttttgggagtcgcggtacttatcttgtttttctttttgatcgccggcattgtgacagggattttcagccttctgatgcctattatgggccccttgcttttggtatttctcattgtctggatcgtaagaggaacgaaacgataaagtcatatatatttaataattaaaaacaaatgttacagaagtgtgacggcattcatgacgcaaaaagtgtcatgaatgccgtttttgcttgacaaatacggggaataagtatataattcgaattgtaacatttatgtaacattttggctgagttttgcaggaatgacagaaaaacgtaaaaaacaggagatttgatatgaaaaataaaatgtggaaggcaatggggtttttagggcttttagcgagcttaagctgggtttcccctgcagaggcgaaagcagcggagatcgctgttgaaaccagcacgacactttatgcaaagatggacatgcctgtatctgtcagggaagctgcaaatacggcaggaacagtactttcccaggccggggagggccagacttatgaagtggtggaatctcccaaggatggctggattaaaataaagactccctcaggagatggatacatacaaagcagttctgcgacactgattgaaaaaaaccaggaaaaggtggacaagtctgttcttcagcgccagcagatcgtggattatgcccttcagtttgtgggcggacgctatgtctacggaggagtcaatcccaaaacaggagtggattgttccggttttaccagatatgtgcttgcgaatacggccggtgtcaatttaagccacagttcaaagtcgcagtcaagggagggccgcagtttgagctacgaggaagcccgggcaggtgatctggtattttatggaaaaaatggatccattaaccatgttgccctttatatgggagacggccgggtagtccacgcttccacagaaaagaccggaattatcgtaacaaacgtcatgtatcgcaaacctgtgaaatttgtccgggttttaaactaaaatattttgaatttcgtgcagttttaaataatacttgacgaaaagataaaataaatgtataataaccgtaatgaatttaatatttacgtaacatttgaaactcaaaaagtaaaattaggagcagatttcccgatgataaacaaagcatggaaaacgttaggccttatggctttttgcggagcaatgataattgcagatccttcagatgtaagagcagatgaaatttcaggtccaggactcagttatgggaactatatggtgaccgttgatgcagataatgtaacgatcagcaaggatgaagctggtcaggaagcgttgatgaccgcttccaaaggatcttcctttgaagttgtagaggatatgggcgacggaaaaattaaggtcaagatcaatgatacatatggctttctgccagcagaggggaatgccaccatatcatcgacagatgaggaaacactggcagccctggaggtaaaaactcaggcacaggtggcagtggatttcagacaaagcattgttaattacgcacttcagtttgtaggcgggcgttattcctatggcggcagcgacccgcacaccggagtagactgttccggatttaccagatatgtgatgcagcacgcagcgggccttaccataaaccgttcatcagggggacaggcttctcagggaagggcagttggcgctgaccagatgcgtcccggcgatttgatcttttatggtagcggatcttccataaatcatgttgccatgtatatcggcaatggacaagtagttcattcatcaacttacagtacaggcattaagacttctccgtggaactatcgggcgcctgtaaaaatcgtcaatgttcttggcgattaatgaaatagcggattaccggattttggaaagggatatagggccttcggcatgggattgccgaaggtcttttgtttgatttgatgtaaaaaaggacaaagagaaacagacggacaggggagccatccggctgtttctgaggggagtataaataattaataaggatgaggaaataaattcctcattttgattataatatagtcttgatgaaaatgcaaagttatttttaaattttaaaataaaaatgatagtataatctgtcggaaattcgccatactagaccatgtaacgtaaaacgccgacaggaggtatttattatgtctaagaataattacaatgatatggacaattcttccaggaattcccataacaacaatcaaaacaacagccagaataacaaccagaacaacagccagaataacaaccagaacaacaatcagaacaacagccagaacaacaaccagaacaacaatcagaacaacaaccgcaactccagcaaggacagcagccgcgattccagcagagacagcagccgcaacagattcaactaattaggtctggccgaaccgattattaaaaaaggcgtgggaaagagacaaaggggtcctttcccgcgtttttttgttgggactggcctgcttttgcatgattttcgcaatccggaaattatggaatatattattactagaaaggacgggtgataatatgttcaggaccattccgatttgggaagtcgatcattatatcaattataacaacaacattatgattatagatcttcgcagtgagacgtcctataggcaatcccatattaggggagcagtgaatctgccatatgaagatatggatcaatgggtgagcagtttgccaaaggataaacttttgatattttactgttccaggggcggacaaagcatgatcgtctgcagaaatctggagcaggccggatacaatgtggtcaatatagccaatggaattgcgtattacagaggaaaatatatggttcgcggataggtaatttcattgacagaaataccccgctagccttaaaatatacctattaaatacaaaaggagaaaacgacttatgagatatatgattgcttccgacattcatggttctgcctatttttgcaggaagctgttagatgcatataaaacttccggagcaggcaggctgatcctgttaggagatattctttatcatggcccaagaaatgatcttccaagagaatatgctcctaaagaggtgatttccatgttaaatgagtgcaaggaccagatctattgtgtgcggggaaactgtgacactgaagtggatcagatggtgcttgaatttcctatccttggggattatgccctgcttgctgtccatgggctgacaatttatgccactcatgggcatatttacaataaggagaatttgcccccaatacaaaaaggtgatatcctgcttcatgggcatactcatatcctgactgcagagcgctttggtgatattaccatattaaatccaggttccgtgtccattccaaagggcggcaatcctcctacttatggaatgctggaggataaaatattccgcattatggactttgacgggaatgtgataaaagaaatgaacttaggagaataaggtgaaaaaaacatttgagttgattgcaccctgtcactttggcatggaagcagtcttaaaaagagaaattattgatctgggttatgatattgcatcggtagaagacggaagagtcacctttgtcggagatgatgaggcgatctgccgggccaatgtgtttctgcgtacggcagaaagggttttgttgaaggtgggaagctttcacggggaatcctttgaagaactttttcagggaaccagggcgatctgctgggaggattatatccctcaggatggaaaattctgggtcgcaaaggcttcttccataaaaagtaaattgttcagcccctctgatatccaatccatcatgaaaaaggccatggtggagcggttaaaaggggcttatggtgttgaatggtttccggagactggaagcagctatcctttacgggtattcctccacaaggatcaggtgactgttggaattgataccacaggagattccctccacaagagagggtaccgtacattaaccagtaaagcgcctattacggagacccttgctgctgcccttattatgctgaccccctggaacaaggacagaattctggtagatcctttctgcggaagcgggacatttgtgattgaggcggccatgatggcagccaatatggctcccggcatgaaccgttcctttcttgcggaggagtggaaaaacctgattccaagaaagtgctggtatgaaaccatggatgaggcaggcgatcttgtggataccgatgtcaaagtggacatacaggggtatgatatagacggtgagatcgtaaaggctgccagagccaatgcagagtcagcgggagtggaccatatgatccatttccagcaaagaccccttgccgctttaagccatcctaaaaaatacggttttatcattacaaatccgccttatggggaacgaattgaagataagaagaacttaccggagctttatcggcagatcggggaacggtataaggtccttgatgcctggtccctgtacatgatcacagcctatgaggaggcggagaagtacatcggcagaaaggcagataagaaccggaagatttataatggtatgatgaaaacctatttctatcagttcatggggccaaagcccccaaaaagaaaagtgggagattcggttgaagaataaaagatggttttccctacttctgataatcgcctgttttgcagcaggattccggatttccggtgaggaagcgcatccggtaaacggaacaggccaaaactacttgaaggagtcagaaagcggggagacacatggccggacagagtcccggaaagaggaaattttagacggaaagctcccgtcttcctatgacgggagaaaggaaggccgggttccttctgtgaaaaatcagggttccattggcacctgctgggcctttgcatcgctccaggccctggaagccgggcttctgcctgaggaaagtcatgatttttcggaagaccatatgtccttaaataatggcttttgtattccccaggaagagggcggggaatacaccatgtccatggcctatctgctgtcctggagaggccctgtatcagaagcagatgatccttacggtgacggcatttcgccggatggcttaaaagcagaaaagcacgttcaggagattcaaatccttcctgagaaggattatgagaagatcaagagggctgttttaatgtatggcggggtgcaaagctccctttatacttccctgaccggcgaagacagccggtctgtttcctacaatgaggaggagtttgcctactgctacataggcccggagcttcccaaccatgattccgtgatcattggctgggatgatgcgtattctaaggaaaactttcgtgaggatgttcagggaaatggggcatttatctgcatgaacagctggggagacggattcggggaccagggatatttttatgtctcctattatgattccaatatcggaaggaataatattgtttatacccttgtggaagatacagataattatgaccatatttatcagtcggatttaagaggctgggtaggccagttaggatatggggaagataccctgtggctttccaatgtatacgaagcagggactcttgaaagtcttgcagcggcaggcttctatgccacgggccccggaagctcctatgaggtttatgtagtacgtcatgcaggggaagaatctgatattgtggaaggccgggatttcgaccggaaaattctcctggctaaggggagctttgattatggaggatattatacggttccgcttatgggaaatcagcaggaggatcttaggctcactcctggggaacggtttgcggtgatcgttaaaatcaccaccccggatgcggtccatcccgcggccattgagtatgatgcaggggacggccgtacgtttgttaatatctcagacggggaaggttatatcagcgccaatggcagtgcatgggaacgtgctgagagccagaactgcaacttatgcttaaaggcttacacaaaagaccggtaaaaaacatgatggaggaaggaaaagatgaacgataaaaagatcgtatttgccacagggaatgatgggaaaatgcgggagatcagggagatccttaaggacctgggaatggaagtcctctccatgaaagaggccggagtaaccttggatattgtggaagacggaaatacatttggggataacgccgagctaaaagccagggcagtgtggaaagaaaccggagggatcgtgcttgcggatgattccggcctggttgtggactgcttaaacggggagcctggaatcctttctgccagatatatgggggaggatacctcctatgaaattaagaatcagaatatccttgacagagcctctcacgcaaagggcagtgaaagaagcgcccgttttatttgcaatatcgctgcggtgcttcctgatggacaggtgcttcatacggaagagtccatggaagggctgctggctgatcggcctgccggagaggagggctttggttatgatcctatcctctatataccggaattcggagcaaccagcgcccagcttaccctggatcagaagaataagatcagccaccggggaaaggctttggaggccatgaagggccggcttatagaaatttttacaggaggggagaatcatgaaagtactgattgtcagtgatacgcaccgcaaagatgaaagtttaaagaaaatcattgcagagactaagccgcttgacatgctgatccatctgggagattcggaaggcagtgaagaaaagatagctggctggattcccgctggctgtgagcttcagatggtccttggaaacaatgattttttctcggatctggaccgggaaagggaagtaaagatagggaaataccgggctttactgacccatgggcattattataatgtgtctcttggggtggagcgcctggagcaggaggcggcggatagaggtcttgacatggctatgtacggccatacccacaagcctttttatgaggtacataatgggatcacgattttaaatccgggcagcctttcttatccgcggcaggaaggcagaaagccatcctacatgattatggagatcgatgagcagggggaggctcattttaccctgaaatttctggacaaataggcgttttttttagaaaaaattgggccgtttaccagaaaacagataaaaggaccgtttctagcccatccatccgattataggaagtgctttttacttcccataatataaataagaagcggctgcaaaaaagagtatctgtatttgatctcctttttgcagccgcttcttatttttttacatcattatttccagccttccggcaaataagccatggtgttttctatcatgtcgtctgccagctttttgatctctttttcccctgcgcgtccttttaccagaggatcgcttaagaacgcttcatataccagggagcggtcataagtgagggcagcctccagaatacgctgatggttggcaatgtgaggcatgatcagttcaagaacattttctggtatggagcctgctacaacaggcttaatgctgtccctgctgaacagggcgttggtctcaacaacagcgtctgcgggcaggtttggaatctgtaagaaggaattagggatattgacattgctgacggtcctttcaaggccgcatatggctttgatgagcaggatcccttcttctcccgacggctttaaatcaatttcctcttctccgcttacaagacggtggctctttgccaaacggtttttcaaatcctcttttctccaggcaacggtggtgaggccgaatttccagctctttacggtttcagggtcttttaagtaatcggttccgggcataaattctgcaaggtggcggtcaccggcagcagcaatcaggccatagcggcggaaaagatcaaattttactctgtgggcgcattcaaagctgttgtttgcccagttcttgtcaggctcattgtaaccttcctcataatgggcatcaatgtaatcacggtaaacagggaacaagtcgattcccttgtaggaagcctggtcaaaccaggtgaaatggttgattcccagaacgtttacatggatgtcgcggcggtccacatgttcaaaaccaaaggtttcttcacagattccctttaaaactttctgggtgccgaacacctcatggcagcagccaaaagccttgatccgggggaatacatgataaagagtcttcacacacaaggacatgggattcgtgtagttgatgacccaggcatcgggagcgtattttttaactgcttcagcgatggttacgaacatgggaatggtgcggagggcgcggatcattcctcccggtccagcggtatcgcctacggactggtagataccaagcctctccggaaggtggacatcggaatccatttcatcaaaggttccggggagtatggagatgactataaaatcacagcctgtcagggcatcctctaaggaagatgcggtaatgtaattccattttccggtggtatcttccctgcttgtcagtttattgccaatgttctcattgttttttgcggctgcctcgtcaatgtcatacaaacggatggtcccgcttaaagaatcatccatggaaagatccgtcataaaggtccaggcccagcctctggagccgccgccgatgtaggcgatattaatatcgctgactttgttgtttgcgtatttcatagggtatcctcctgttaaaagaatttgttttataaaatgttttttaggctctctattacatattgctgaaagtaataaacgctttcgataattggatggacggggcaaagaataccccttatatcttccattgcattgcaagtgaagataagttatattataatggattatagtattataaatctaatataattgggactttttttgacagaatcatacttttggctactattttggaggttgagatggaaaaaaccatattttcagaaatcatggaaggaattacaatggaccgggtggtcagggatcaggaatattccatgccaatgaagcattttcacgacacctatgagctttattttctcctggaaggagagcgccattattttatagagaaacaaacctattatgtgaaaacaggggatgtggtcctgataaaccgggaacaggttcataagacaagccaggcgggaagtaaaaagcatgacaggatccttctccagctaagcgggagagttttggagccatggcttaagagtgcagggctgtattcccttgagaggatatttgacgattattatggggtgaccaggcttactgaaaaagaatgggatgagataaaagagcttttgctggggatttcagaggaaatgatccacaggagggagaggtatgaggtgatggtaaggctgaagctctcccagattttactgatggtctgccgcagcaggaagaaaaacctgcttaaagaaatgcctcagacggtgcagaccgcaaagcatggaaaggtccacgaagtggcggaatatttgactctccactgcgagacaggggagagtctggaggagctttcagaaagctttttcatcagcaaatcctatttaagcagaatattccgggaggtcaccggattttccgtaaatgaataccggaacctggccagagtgagaaaggcgagagagcttctggcaggcagcgggtattctattacggaaatatcggagattcttggatttgaaagcgttacctattttgaacgggtatttaaaaagcatacggatatgacgcctctgaaatatagaaaggatgcgggtggagtccattgatacaagcggcaccgcaggatcattccttttgcagagcctcgtataaagcagtcagggtaagggcttgtccgtaggccatgggcataagggagatgttcttataatgatcggaattcatgccgattccggttcctgctgacacgtttaatacggttccatcctcagaaatattggcacagatggcgtcaatggcccggtcagctgctgccttatacctactgtcaaggatccctgatttcacaccccttaaaagccctgcggcaatggctgcggagccggagacttcatcatagctggaggcgtcggtgagaacggtgtgccacagtccggagaccgactggaggcgtaaaagggcggctgcctgggatttgaaggtgtctgttaagaaggccctcaccccttcgtttaaatcgtccccgcaggtatctaagtattccatgatgccgtaggtaaaccaggagtttcctctgcaccagaagatgcctccgaaattatccatgcgctcaaagctgaagccgtgatggaagaggccggtctgcttatcaaaaagatatttaatatggaccagaaactggtgaagggcttcgtccttccaaagagcatttttggatatgtatcccatattgtttaagaaaagtatggacataaacagagtatcaacccagatctgcccgtcatttaagctcactccatcccggtttccaatggcgctggtcacgtgctggaatccgttgtcctgagtttttggaaggtcattgatgagccagtccgccctctggacgcacagatcataaaattctaccggattgccaagacttccatataaaaaggacaggggaagaaagggtgctgtggtgttaatatttttggagggaagtccttttttccggtggccgctgtaccatttctcaaagaagggaagatacctttcgtctccgtaaaactcctggagcttatataagccgtacagccccacaccctggggccagtcccattcctctattccgaaatccctttggatgagtcccttttttgtgtcagtgctgctgacggtcttgtctttatcgtagtcatatcctccaagattcatcagtttctccacaaccagatggattttttcaagcagctgttcgtttgtcattactatgttctcctttttcattttaattaaagcttgtttttcagtttttctatatattcggtcggcggaaggccggtataccgcttaaatacctggctgaagtactggggattgctgccgaatccaacctgtcgtgcaatgtgtttaatgttatcattatgatagtaggccatcagccggatggattcctccattcgttccttgtttaagtaatcggaaaaacgcatcccttcctccttgataaactgcttgcttaaatatcccacgcttacgaaaagataattctcggccagccactttagggaaagattttcagagtataaatgttctctgatgtaggcctttaaaagggcgatgttggagcctgtcttatgggccccgggcattgtgtctttctgtaccagcacaacacgaaggagctcccggattccgtaaaccgtatcacaggaatagaggcgccggaaaaagtcacaggcagcatccacaggaagtttttcctctggcccggcctgaaggaataagcctaatgcaaggtttcttgcggtggctaaggggatggagtccatgaaaacagaatcaagtagctctgcggcttgcaccgtatctgccgctgaggtgatggaatcctccagccggctgatcatccaggggaagcgatgtggtttctgatctcatgaacctctcccccttcgcctatgagaaggatccgttcaaagcgtgaaattttctgaacgatctcctggaaaagcttttcggcggaatccctgtgaagaaagtctgcttcaaaggtgacggactggccgggatacttaagccgggtaatggcattttggatccgttcctgaattgccagagtaaaggccgggaatatgaggaccgcagagtttttcacataaaggatggaaaactgcaagggaaccttggaggcatccaaaagctttctcacatcacagataaagcttttcaaatagctttcttccacaaaggaacagatgcaggcataaacgcagtcctttggaagggataataggacctggtatttgcggaacacggcggaaaaggagtcctggtgctccagggcttccataataaagctctgctccagggggaaatgaaggcttcttaggaaatcctgctgctgcatttttctgctttccttttcctcaaggcgttcctttcttatggagagcaaagattcgatcagctcatttttatcggttggctttaataggtaataccggactccgtatttcatggcctgtttggcatattcaaaatcattgtagccggaaagaaggataaaggtgatattggaatccgattttatggaacgctcaattaagtccaggccatttaggatgggcatccggatatcagtaatcaccacatccggataatcgtcacagatgatatcgtaggcctccatcccgtttttcgcagtggcgatgagctcatagcctatggactcatagtcgatcatttgggaaagtgcctctcttataatctgttcatcatctacaatcatcagtctcagcatatcaaatctccttttccttattactgtccacgctttctggacatagaggtatccccgcagggggcttccttattactgtccacgctttttggatatagaggtatccccgcagggggggtccttaggaatggacagcattactactgccatatctttttcgttataaaatttcaggccataatgttccccatagagcagctttaaccgggaatgaatgttggtcagaccaacacctgaaccctggggtctgatctctttgtgcctgattttttctaaaaggtctgattcgaaccgggatccggtgttggacacccggatttcataatctttctccatttcctctatgaccacctgtatcctgcacatctcatcagtatcctccatggcatgctttaaagcgttttcaaccaggggctgaatacagagctttggaacggaaatatgggcaatgttctccggaactttaagctcaaaatgaagcctgtccttaaaacgaatctcctggatgcggatgtaattatccagtacctccaactcatcttccagggggataatgtccttttgtcctgcaatggaggcccgaaacaggttcccaagggaacggaccataacggagatgtcatcggctccgtatttctgcgccatccagttgattgtatccagggtattgtataaaaagtgaggattgatctgctgctggagcattttaatggtggaatccctaagcagaagcttcttatcataattttcatcacgaagaacctttacgctgtgggtcatttcatcaaagctcctgtgaagctggccgatttcgtcctgtcggttttcatagtcatagcattttacatcacaggtcagagattccccgcttccgaacttctggatcttttcaatcaaatagtccaggtgacggaaaatatggcggaaaatcaggttaacataggttgcggtgataaatatgacaaagacggtaaatataatgatctgaaggctcacaagctggatcctgtaaaaaagcggatcataatccctgaaataaatataatcccagtccacatagggaacatggccggaaatgataaattcctttttattgtccagtgtggaaatgaggtaggcgttctcctgctgctttctgcctgcaatgatttccgcgcagtacgcatcgtgaaaggcagttgcagggtaaatccttttatcccctgacatcagaatgaaattggagtcttccacaaggctgccggcactttttaaaccgtcctcaatcatgcgctccatgttcaccgtaatgtatagcccagccagcttttttaagcttaaatatttcatctttaatatctgcctggcgcataccgtatcgtttcccggttctatgccaggggaccaggttacttttccctttaggtcactggttgtcttgtcaagctcctttaggtcgaatttaaggatctcgtcagagcttcccatacagatatttgttccgtcagccaggataatgttaatggattttatatatttgctgcggtaaacataggaataaagctgctgataaatatcctgacgtgcctgggcccggcggttgctgaaaggcttctcagccaaaaacaccagattatcctgaatgacgggatcaccgatcatgttgtaagatatggtttggatcagctgtgtctccgattccagataagtggtcacacgatttaaggaattggcattggtgcggtacagctcctcattatagcgggaggtgagaatcctgatgctgataaggaaggtaatacaaaccgccagcagggccagaaggaaaatggtcagtatttttttgtataatgacaggttgttaaaccagaacgtacatcgcttcataatcaattatcctttcccaagtaatcgtattatatagtaaaagtataaaaaaagaaattgtaaaacagtctattattacagaaagccgtttttttaatcataaaaagccatattttaactttaccgttgtgcatatttgccataaaatgtgcttatcacaaaaaacttaaagggaggttttacaattgagaaagagattattagcaacatcacttgctgcacttcttgcggcaacatctttgactgcctgcggttccaagacagaaagtccggataccaccacagcaggagcagctacaacagcagcgtcaaccgcaaaggctgatggtgaaacacaggccgcatcaggagacaaggtgaccttaaacgtttgctggtggggaaatcagaccagaaacgacgtaacaaaaaaagctgcggatttatacatgagtcagaatccaaacgtagaaatcaaggtggagtttaccgactggggcggttactgggataaactttccgccatggcagcaggaggtaatttaccggacatcatccaaatggattactcctatctgaatcagtatcagaagagcggccagctggctaatttatcagaattcatttccagcggagtcattgatacttccaagatcccggagagcgtcattgagagcggttctattgatggaaaatgttatgccctcagccttggaagcaacgctcctttaatggtttatgataaggccattgttgaaaaggccggagtgaccattcccgagcagatgacctttgatgaattatatgatatttcaaaaaccatttacgagaaaactggggtaaagaccgtttttgacggctggatcaacatgcttcagatgacggcaagaacaaatggttcccatatattcgatgagttaattgcaggcaacgaagattccacgaaaatacattttgccaatgtggagaaattccagaaagcagagttttccattgcaccagatattctggttgaaaagaacccggataacattgaaacaaagccgattgtagatgaaaccacttggaatgacttcccatattctaatcagtttatcagcctttccaatgcagccggaagagagttagaagtaacgatgaaccctattcttccaaatggtacgcagaatatgtatttaaagccaagccagttcttctccattgctgaaacctccaagaacaaagaggaagcagcaaagttcattgactggttcaccaacagtgtggaatgtaatgaaatccttatggcagaaagaggaatcccggttaatactgaggtagcagaagcgattaaaccaaaggtagatgctgttgcacagaaggtatttgactatgtagcaaaggtttcagagattgcggttccgattgatgagccagatccggccggtaagggcgaagtggaggctttgaccaagagtgtggtagaagcaatccgctatggtgatacaaccgctgaggatgcggcagccagctttgtgcctgaagcgaaaaagattttggaagaagcagcaaaatagtgacagaaaagtctggagggaattaagatgaagaacaatcaaatgatccccaaaagaaaaaaatcattttcccaggtaatgaacacaccgaaggttgcaggatatgtatttatcctgcccttcattataggctttcttgccttcttggctgttcccatgattttttctttagggttttcgtttaccagatacaatattttaaaatcaccggtttttataggtctggaaaattacaaggccatgtttacagcggatccaaagttttggaaagtatttggcgtgaccatgtactatgttctgttttcggttcctctccggcttttaatggctctgcttgtagctatgctgcttgtaaaaacaaccaaattgtccggcttttacagagctgtttattatcttccttccatcattggatccagtgtggctgttgccattctctggaagcggatgtttgccagtgatggtgtaataaatgcaattttaaatgttattggattaccgtccgacactgcatggctgggaagagcggataccgctatctggaccctgattatccttgctgtctggcagttcggttcctctatgctcatatttctatccgggttaaagcagattcccataagtctttacgaggcagctaccgtagatggggcaaatggcattcagcgtttctttaagatcacgatcccaatgctgacaccaaccattttctttaatctgattaaccagctgatcaacggctttatggcatttactcaaagctatattatcacccagggaaaacccaaggactctacactgttttatacagtatatatgtaccagaattcctttacgtataacaagctgggctatggctgtgcaatggcatggttcatggtgctcgtagttgggcttttgaccttcatacttttcaagacgcagaagaaatgggtatattatgaatcagaagggtgaaaaggttgaaagaaaaacgcctttcagcattgagtttatgaacagcgtgccccgttttaccgggtatcaactggatatgcaagcatatccgtttgatttattaggagacaaaatatgaaaacaggatatagagaaaaaagaatagccgccacagtggtttatcatgtattcaccttcttacttgcatgtgttatgatatacccccttgtgtggatggtgatgagttcctttaagaactccaatgaaatattccggacagctgccaaactgctgcctgataaattctcttttgaaaactatcgaataggctggcagggctttgccggttatggttttggcacgttttttaaaaattcatttatcatttcaggcctttccacggttggggcggttgtttcttctgccattgtaggctatggatttgcccgtattgatttcaagtttaaagacttctggtttgcatgtatgctgcttgccatgatgcttccgtttcagatcatcatgattccccagtatattatttttaacaaaatgggctgggtaggaagctatcttcccatcattgtacctcagttttttggtcagggctttttcattttcttaaatgtacagtttataaaggggatccccattgatttagatgaggccgccagaatggatggatgcaccatatactccatattcataaggatcatccttccgctcattaagccctctctggtgaccagtgctatattctcctttatgtggagatgggatgattttatgacggctctgcttttcttaagcgatccccttaaatatccggtcagctatgcattaaagatgttctctgacccaacggccggctctgactggggcgcaatgtttgcaatggcaaccttttccctggttcctatttttctgattttcttaaccatgcagaaatatctggtggaaggtattgcttctacaggaataaagggctgaaacagacttttaagcaggaaaaccgcttcgcggctttcctgttttttaatggtgattaattatcattcggcattaattgaacatttttctcgtttaccagcttgcccaatggttacaggatattatataatttcctggttagctaaaactaacttcaatcatatgcaaggaggaatatatgagaggcagaaataaggttaggttcatagcggctatgaccgccatgaatctggtgtttaccatccagccatttgcgggggagtggaggcaagatggagataagtggcgctatattctggaaaatggccttgatcagaaaaattcgtggctgaaaacagatgacggcaaatggtatcatttcgatgagaacggaaacatgagaacaggctggtaccaggacacggatcagaagtggtattatctggagccggacggttctatgtcctccggctggaaggagatcaacggaaagtggtattacctggaaccggacggctccatggcctccggctggaaggagatcaacgggaagtggtattatcttgacaagaagtcaggagaagcgatcgtaaatggctacacgcctgatggatactatgtggacggcagcggggcatggaacggcggttcatcacggaataatcaggatgacagcagttcagacgacgagcccccaaggaataacaatacaggggaaaacggaaacaaccagccgggagaagaaaataatcagcctggaggaggaaacaatcagccagggggaggaaacaacggaaatgagaatcccggaaataatggaaacgagggcggcgaaaatccctgggaaaacaaaagtcctgttatcctggaacaaaccggaatcgtatctgttatggggcttccttatgcagtcatatcgttttccgatcaggcagagggtatggagggattccgttattccatagcagggaaagatgccacatcctccgtcactcctgtgacaagctcaggcaggattgtaaaaatacctttgccggatgaaaatacccatacactggccataacctccggtaaatggacggtatccgtgattgcgctgggagagcggggaaagagcgctgtggcggagaaagagcttatggaagcagaccttttccttccatcagatattccatatgtggtacttacaaaggcaaccattcctcttacccagtacgtgaaatttatccggcagggtgatgacctcttcataaagcccgatgtaactacggtagatactgcagaggtacaagctctggcaagcgtgcagagtccaagccaggaagaggaagaaagctacatcctgatagaggaagataaccgggcaacaaccggtcttatgagctttgcttcggatgcagtggcaagtgcgacggccgcacctcctgcaagcctggagggaaaggaagagatagccacaattgccgtattgtttgatttggcagccaataatatcattgcggacagtctggaaattgagacctcgtctgtagaggcgtttctgtctaaatgggagccctcggagaaattgactgcgttaaatgagagcctgaccctgagtacagaggcgaaagatcttaaaacaagaacctggaaaaaagctgaggagctgccccgatatgtgaagtatttaacagacaaaggcggttacggaacaaaagttgagctgttaacaggaaaaacggataataccaatccgcctgagatgaccattgccccttcattaaaaggaaagagtgcggccatacagctcagtgaggaaaatgaatcctggtaccgttcaattactgaaattgaaattccttacagtgaaaccaagacccattattatcaggaaaacaataccttgtccgcagatgggaaaactgtgacactgggagtggatgccatcagcggccccatgaattacgccgggacttatgaggttacgattcattcctttgggtttgatgatgtgaaaggcactctttctgtagtagagcaggctccaaactttacgcccacatgggatgacagcaacagccgtttaagattaaaagcggattttgcatactatgcagatcgggtaaagacagtcactgtaaacggaaaccggctggaaaccggcagttttacaaatgacatcaacagtctttatatttcttaccgctatctggtaaacgggaaaaatacctttgaaattcaggcagacgggtatgaaaataccagctttgagattgaatccccggcagggtttgtcactcctaagaaagcagcgtctgttacagtgagagaagttattgacggttcttccgctatggtatttgatatcggctcctatcaggagggaagcgatgagatggaatggttccaggctttggaagacggccatcttaagctgacatattcatcatatggaagtgtatcaggcctatctcttacaaaagaaggcagcagctttacggtcactgcaaaaagcactgcaatgtcttattacaataattacaccatgcagatcaccgtaccgggatacgacatagtaaccgtaacctttactcccgtaaaagcaccgcctgttgtaacacagcaatggaacttagaaaattacagtctgaatcttaccagctcttccaatgccatgtacttaagctcctatgtaacaaaggtgattttaaatggaatggagctgaaaaaaggagaaagcgctgattatacggtttcctatgaccgtgggatcgagatttttgcccacaactttacagccggaacgccatataaaattgagctttatgcctcctcctatgctttgaatgtattggaaggaacaactcccgcagagttaataactcctatggaagccccggcgcttaaagcggaagccgtgccaaggggaagtgatgtaacggtgacggtatcaggagaagcagccgaatggctggataagatcagttcaataactgtggcaagctcctccggttcttccggcagtgcagccagctatacaaaaacatcccatggattgattttaaattccagcaatttttcctattccggaacttatatcatcacagtaaaagccgatggctaccggacggctcagacagaagtgaagatcttaagtacggttgtggttacgggcgcagtgaattatgacgaagaacgcctggagctgtcagccggtgattcctacttttatgacaatgtgaccgtatccttaaatggaacccaactggtaaagggcacaggatatacaacaagcggaagcaaaataatttatattcccgccgctctgctcacggaagaagagaatcatctggttttacataatgagacctaccaaaaggtggaaatgagttttggaaggtacattgccgctaaatcggcgccaaagctggaaatagaaatgggaagctccttggataaggaaaatgcaattgttctgatcgccgctgatggggatcaggaatggtgggattctctggaccagtcccacatttctgtaaaacgttcttccaccagtcagacggttaccggatttgatgcaagttcagcagatcagctgacgattcaattaaaggattcattatcatattactatagctataccgtaacaatttcagtgccgggataccgtacctgcagccttaccttcactccttaccagaaagcgccggagatagaagatgagtggctggaaaacggggatctgcagctttccactggtacatccggctatttcagcagcacctacattaatgtttatctggatggcgaaaagctggtccgaactacggattatagcttggatacatatagttcgccttacagcctgactatttttgcagagaagtttacttccggagagcatacggtaaggcttgttcatacagggtattccaattatgcgccatatgaaatcacagtaacagctgaggaaagagaaagtagtctggcaatggaagtaatggaattagtcctggaaaaaccggcagcagaagcagcaaagaatcctgagggagaagaagagaataagccttcagaagaaaatgcggaagagaatctgccagaaaaaaatctgccagaagaaaattcagaagaagaaaatctgccagaagaaaattcagaagaagaaaacctgccagaagagaatcaggagaaagaaaacccggcagaggagaatcaggaaaaagaaaatccggcagaggaaaatccggcagaagaaagttcggaagatgatccaacagaagagaccccggcagaggaaacgaagacggatggtgcccaggaacaaaatggagaggaagcatctgaggaaaatctgactgaggaagaaggcggatctctggatgataacggtgcagaggattctgtacaggaacaggacaatgcggtcaaagaggaagatgatctgcatcagctgcctgaaaatgagtaaggatagtcttttttaatgttataaaaatggagaaagccggcaggaggggatcctgccggcttagtataaaaaaatgtatataaaagggctctctggcctgtttacaggtattaatataggagggaaatgtgttggaaaagtgaagaatctgtgaaagacgggaaaaaataaaaaatggagcaccgcaggattggggaaatacggcactcctaagaagagttatataaattatagcgcaattaatcgattaagtaaagggaaataagtaattttttatggatttgccgttaattttttgtaaatatattggggtttatgactatataatataaataaacatgttatagttctattgctgctttattctgaaactcatagctgattcttctgctcatattggaaaccctactgcataaaatatatcatatgcttcatttgaaacaggcaggaggccgcaatatggaaaaaatactggataatcggtattatgatctgatcataagtaataccctggttccatcctataatactggtgataatattacgatgctgaatgaattcaattccctgctgcatataccaaaggatcggatggaggcctgtgatctgggcatcaatgcctatcattcctttccgaccttatataccttggaatcatcggtcagcattgagaggtccgggatcggagctgttcaacggactcctgctcttggtatgcatggaagaggagtaatcattggtattgtggattctggtatcgattaccgtcatccggcatttaagtataatgacagaacaaccagaatcctgtctatatgggatcagacccaggtgggaagtacgcctcccagagggtttacttttggcgcggaatataccaaagaactgataaatttcgcattaatatctgaaacgcccttttccattgttcctgaggttgataccgtccgccatggaaccgccattgcaagcatcattgccggccggcccaacgatgattataatttcagcggtgttgttccggatgcagatatggtggttgtaaaactgaaagaggcaaaggaaaacctaaaaaggctgttttttgttccgcaaggcactttgtgctaccaggaatcagacatcatccttggaatccggtacttagtcgccactgctcaaaggctgaaccgtcctcttgtgatatgcattgctcttggaagcagtcagggagggcatgatgggaggggagcctccagcatttatcttgattatctggtgcagacacctaagctgggagtggttgttgccgcgggaaatgaagggagcagcagaaggcattatttcaatgatacccggtcagtcccctatttgagcaactttcggttgaatgtgggaatcaatgataagggattttccatggaaatctggccttatatcccttcaaggctttttattgaggtcactgctcccacctttgaatcatcacgtaccatttatccttcattcgcgaattgtgaaagaattgtttttcagtccgttgataccgtagtctgggtaaataataatatttttgaggtggaaagcggggatcagctgatcctggtccgttttgagaatgttgctccggggacctggtatttcagggtcggcagcgtggagaatgaaccgttctcattccattgctggctgccgtctggaaatatcatatccaatgagacctttttcctggattccagtccggatacgaccataacatcccagggagatgccgtccatcctttgacggttgcggcctataatcagaatgatggaacaatccttaatgagtcaagcagaggatataccagactggggctggtgaaaccggatgtaagcgctcccggctatctgcttccctgtgcgcttccggattttcaatacggaaccgctacaggcaccggagcggccgccgcccatgcggcaggggttgcagccatggtgatggagtgggggtacaataaaggaaactatacggctgttaccggatatcaggtcaaccgggtgattatacgcggagcaaagcgggatcctgtcaatatttatcccaacaatgtatggggatacggacaggtggatgcggaaaatatgttcaggcagctgactacctattaagatataaaccttcaggcagagcgggatctccggcagtctggaggtttttgctttgataagcctgccatgctttggaagaaggagttgggaacctttgaagagagaaatgcatcaactaaaataggtgatcatcacctgacagaaaggctttaaagatgtatttctgaattgagaaaagaaggtgttattatggaagagatcatgaactacgtaaaaccggaactggtgatagtggcagtggccctctacctattggggcaatggatcaagcaaagccagacgattaaggacaaatacatcccgctgattaacggaattgtgggcatagttttaagcggtgtctacatcatgtccgtttgtgaggtacacaccatccaacagatttctacggcagcatttacggcaattactcaggggatcctggtggccggactgagcacgtacgtggatcagctgattaaacaatccggtaaaaacgaatagcgggagattgtctgtggcaggggtctgggagtttcccgggcccttttcccatgaagcgcaggtcagaaatggcgggtttacggaaacccggcccgcctattttcttttttttaattcctttctgatcctgggttcaatccctctgcgctccatttccgccataatactttcaaattctccgggaggcgcagaagggggaatgacatccctgctggcagcctctaaccggtcaaattctttttccagccttttttcacatttcttattccagtgtctcaaactatcacctcccagaaaattatataacagttgtaaagaaccttttatgtaagtttccggacaaatgactgaaaattgatttttgagacaattataactgtttttaaagcggcgggtgggccttttttttcgctaaatgctggtaagctgccgaaacagattgttcacattcacctgaccgtatccccatatgttatttgggtaggtataggtgctggtccgcactgccccctcatcatcagacggctgacatcgattccgttcatggtactgtaatgtcctctgacaattgcccattcaaaaaccatggcagtgatgccggctgcatgggctgccgccgctcctgtacctgttacggaaccatacccccctcccggaactgcacaggtgagctgatagccgggagaggctatgtccggtttgacaataccaatccttgtgtagcctctgcttgattcgccgagaatcgagttgttcagctgattgtaggcggtcacagtaagctggcgcctgccgtttccaggagaagtaatggtggtatccggagaggagttaataaaaaaagtctggttggatatgagattgcccgaaggaagccaggaatgaaaggataagggttcatcttcaatagcccggatccgtatacgccagattccgggagtggtgtcttgaaaacgtactaatatgagctggtccccggtctcttcctcaaaaacataattattgacataaatggtggtgggggaaaatacaaaattaaaaatcctgcagtcaccgattgatggataaatctgctgggtggattctctgtttggagaagaaatgtcaatggaaacccgtccaagggagtatgaccagacttccatggaaaacattttgtcatcttctcctattcttaattcaaagtcattgtaataaggttcaacaagtgtggaattaaaataatgtctttgactgtttccctcattaccggctgagacggataatccaatgccgggctgcagcgctaaatcatttaagtaaccgcttaaggcccccctcccgtcatggcccccctggttgcttccgagggcaatgcaagtgactacagggcggctgaatcttgcagatatggtgagagcataacggaatccaagcataatatccgattcctgaaaacataagatatcatcgggaataaaaaaaaatcttcttaaattctcctttgcttccttcagctttaccattacgatatcggattggggaaccacgccgctaaaggtttccaatacattgggagtaccggcgataacgcttgcaatggctgttccgtgtccgttggtgtccgtggagggtacaacggataagggatcatcagaattcaatgcggcattgatttcttccctgctgtattctgtaccaaaggtaaacgcctcaggcggagttccttcctgctgtgtctggtcccatatggtgagaatgcgggtggagccgtcgctgttacggaaggcgggatgctgataatcgattcccgtatcaatcattaaaacaattacaccctctccgaacaaggctaatgcaggattgcgctggatatctccaacaccggtctgttcaaggctgacggtggaagtgggggtatatattgcaggaaaggtgtgagagggatacattaccaaatcacaaatgtttatgttggcaaccgggatatgcagcaaggaatgccgattatttaaataggtaatgttttcatcgttcatggttggagatactgggttggtaatgattaggtcgtaaaagttgttatccaaaatttttttcacagataagtctccttgctgttactgacagtacccattatgccataagcaaaataatagcggctgtctaaaattgggatgtaccggcagcgctgccgggccgttatgcatgttaaatgatatggaataaaatgaaaaaatatgaagaataggcatgaggatattttacaaaataaaaaaacaccgggaatccttatatttacaagaagttccagtgtttttaccaggttaggagcagagaacagaaaaatagggaaaccttccatgccggcttaatccggcaatttatattcacttatgataatggattcccctgaccttcctatcatttctgttgaaattatgtttaccgtggctttgaatgtttcactgcacgcagatgcatccaaataggcattttccagttctttaattgaggcggtatttccaagggttaaatgggggcaataaggatctccgttaaagaactccttcaatgcaccggaatatagcttatcatggatcagacggattgattccgtgccctttactacgtttaaaaacaagtaatttcctgattcaccgggatgtctggaaactccctgcaaagtaatctcaaagggcttgatatttatgagctgactgtctaaatgactgtttaattcatcattgctgatgccgctttggaatggaaagaccaaggtaatgtgcggttttacaaggtctgataaaggatcatatttatttctatagaaattaattacttccatattatgaaactctggaaatatcatgatagttcttgtaatcatactcattctccccgctgagatcatcattgtttgctgctgaatcaaatgaaaaaccatggctggttaatacatcggctgattatcaaaaaaagttaatataggcggcagtcaggaccttgttttccaggatacagctgcaagatgtcctgaaaataatcttgatacttctccatatgtgagataagatactattaagtaagatctcagaaaggaaaacattatgtctgataaaaagtggcttgaatgggctgttgaattgcaggcgatcgcccaggccggactgcattatggaaaggattgttttgatcaggagcggtatgaaagaatccgggagatttcggcggaaatgatcagcaatcaatcggaaatccctgtggaaaaggtcaggggcttattttgctgtgaaacagggtatcaaactcccaagattgattccagagctgctgtttttaaagacaacaggatcctccttgtaaaagaagcagatggaaactggtccctgcccggaggctgggtcgatgtaaatctgtctgtaaaagagaatatcataaaagaagtcagggaggagtccggccttgatgtcagggttgacaaggtcatcgccgtacaggacagagaaaaacacaatcttccggtttatgcctacaagatttgcaagatctttatgcagtgttctgttattggcggttcatttcaagtaaataatgaaaccacggacagtcggtacttttcactggaagaattacctccccttgcggaagaaaaatgtaatgaagaacagatcaggatgtgttttcaggccttctctgatgaaatgtgggaaactgtgctggattaggtagggcagtactgtttattcccttacaaggggctgtgtactgcaccggaaagagccgcctaagcttcgggaaatcttgaagtcaatcaattcaaccgtaatcccgttgtcttttaactgttctgcaatgtattcaaattgaggatccataatgtaaaccgattcatttaccggaagtccgtttattgctaaatgagcaatgtccttatagggaacagaaattttatcccagttttttaaggcctcaggaattcccttcagaaaggcttcctcgcagacgatcatcagaccgtctcttacaaggcttaatgcacaatccaagtggagcacatcgctttttaaaggcacctgaaccacgtcatattcccagtgggataaatatgacttaagccacaggtagccattctggttagaggccagtccggaattccccacaaaaacagtcttgtctaagaccagaacatctcctccctctaaaaatggacccaattcggcatcaaagccctgggaaatatccggtcttggtacggatacataaaacgcgctgctatgataagcctcttttacaagaatatccctgattggaaggatttcgtttctccggtgaaagaagcgcagagaaccttcgatcatggaagagccaacggtgaaaaaaggatcccgggcaaagaaattacagcagccgtattccttgcccatttctttttcatactcagtcagaagccggggacgaagaacctccacaccatatttttcaagtacattttttaagttttcccgttctttttcccattgttcctgacgctgggggaagacgtccttataatcctttcctgcggtatcaacaccgaaatataaatccagactttcttcagtgagaaaagtggtatcattattgatctcctcaagctggggaaagataaattccgattgggtcagcacaaccttctttaagggtgcaaattcacttttcaccagtatcgtttcttttttcattacaaatttattcctttcaaaaaaatctttgccttctcaatgatatggtttattcaacattcttacttaccgcccggaaggcccataaattacagcgagacaggtaaggcagcaggagctgttttcattatgttccatggaccgtatttttaacatgggtgatatagtttaccatattttcatcgtcctgcttgcagtaagtatatcccaaatgatgggaaacctgcagcgcaagagtgcgaaacagaccgcaggccgtgaaaacagctttccagaaattttcagaactgccgtcagagtatgtttttaaataggattcataaaaatcagaaggcaggtattttttataatattttccccacattcctgttgaaacagaaaattcatggttcatggcgatgtaccattctaccattttatcaagctgaacatgtacaacttccgtatacatcctcatggcatagggaatctgatcccttttaattccttttgcaacgttgtttaagcaccaccagaactcattgcagcacccgtcaaacattttctttgtaggagctttgatccagtaaccggtatcacatgaccgggggatttggggcaggagacgatccttgtccagcaagggtaccgtaaggctgtcagagagaaaatgttccatagctttttccctgatcataatacgcagatcgatcctgtttccatctttaaataagataagccagccatatgatttggtaaagtcacagcctttgccccaaccaaagtcattagagtccggttcctgtactacagcaatctctccaaagatattgatccatgatttgttctgtaagaatgattgtgtttccgtaacaacataaacaatatcataatcctgataaatatccttttcaacattaggatttgcacgggagccattcatgtacacggctctgacacgttcatctgctcctgcgacccttaatattatatcaaacatttctttttcactgcgcatgccgatttaccccatataatataataataggaacctttgatatgcttattctaacacggtactatggggaagtaaagaacacccccgattcaaggactatcctgcttttgcttcttcatccttttggatggtatgagtgcagcagcatttgcaaaaaaagagcggaagataaaaagaagaagcattgctttataacctcattggctttaggcagtgcttctttgctcattcacagctgtttatttaaaggctcagccggtgaaaactcaattggctgaaggatcccataacattgacttgtccgtacccccatattggatttggatatacaagaagattgtttcggtaggcgcctcttatcagaagattattaacatcctttcctgtaatagtagtataattaccgcggagaatggcccactccatgatcatagcctgtattccggcaacgtgtgcggcggctgccccggtaccggtagcactcccataggcctgatccggcaatggacatgtaagctgaaacccgggagcagcaatatctggaatagggagcccggaggcggaaaaccccctgctggcttcaatgagaatgctgtcattaaactgattgtacgcggtcacagtaagcggatggttagcattccctggatttgtaacagtaatttccgctgttgcttcaagaaagtatgtattggttgttatgattggaccggaaggcagccatacgttgaaggcagattcgtgcttatccatgcttgtaaccttgatgttccatagtccgctgattgcatttttaaaacgtaccagtataagctgcatgccgctttcttcttccagtataatgttgttgatatataaggtggtagctccataaataaacttgaattcccggcactcatcaagtttgggatggatgatctgggtattttccccaagcggcgatgaaatggaaatggccagacggtatggagaatggttccatagctcaaaaaagaaatccggatctgactggtcaatccgcagttcaaaacttttattataatccgtagtatcaaaggatccataataatgtctgtggtggttgccttcatttccggcagcaatgcatattgacatgccgtggtaggaggccaggttgtttaaataagcaggaagccccccattccgttgtgttcgccctggctggatcccactccaatgcatataacaataggacggtccaattttaaggctacggaacggaggtattcgatgccaagcatgatatcggtttcaagatagcagtcaatgtcatttctgacacaaaagatttggcggttgtatggtttggcctgcttcagcttgacgatcaccagctctgctttagaggccaccccgctgaaatcctctcctaagtcaggagatccggcggcaataccggccagcatagtgccatgtccattgtcatcacgggtcggaacaatggaaaaagggtcattgtcaattaatgccatgttaatggagtcctttttatattcgctgccaaatgtaaaattttccggaggtgtgccatctgtcatggtttgatcccatatggagtgaatccgcgtggaaccatcattataaagaaaagcaggatgctgataatcaattccagtgtcaacaaatccaatgagaacaccctggccaaacaaagaaaaattaggattatattgaaatgattttacgctggacttttccaaactaaaggtagagttaagggtgtaaatatggggaaatatggagtaaggctgttttccaaggagacacataaggaattcgttggcaggtgcatgaagaacggagtatctgtcgtttataaaagtcaaatcatatgtttcctgcaagccttttgcaaattcattgtttatcaacagatcaagataattttcgtctgatattttaatattaagcctccgtatgcagcaagtctcagttttagctattatatgattgtgcgtaaaggaaaatgccagttgcagcgtctggatttgaagaaatggctgtataaaagagttttgaaatttgtgcaataaaagaggaagccggcaagatcgggggaatcctgccggcggttatgaaaaaagtattatactaaggttattggcttttacaattactaatataccgtggaattgtgacggaaatttgatggaactgtgaagagtctgtgaaagaagaaaaggtttgcaggatgaagagatctctgtggatgaagggaacatggtatcagtgattgatgaaaaagatatttttaggctgaaggtaagatgagagaccgggtagagcgaggtacagcctgctgggatggaaatgttatgaatgaactttgaactgatggtggaaacgggtttggttaagtgaagtataaaataatatgtaatatttaatggattttgaagtaccctttattgagcaataggcttaaagccattcccattattaatcccattcccagattgtttattattgcgccgaataataggcccaaactgagtccaagagctaaacagtcctggtatgaatcgtttttgttatttgaattcagcatgtatgtaccccttttgtatttttaaatatcttacatcagttgccggattaagtacactggtattttctgagaatgaaagggaaaaggccatcaagaacgttgatggtgtggaaaaatacaatgggttatgacttttattaaataaagaccggctgcgtaagctttaagccttgaaagttaatattgatagttggcagttttttagataagacgatgttatgatttaaaaggttgaattacgtgttatttatctaatacaaggagaaacaaaaatttgcgaaagacccggaggaggccaacaaatggtattattggttgttgatgtacaacatctgattgttacgcctgatctttatcattacgatttatttgtaaatagtgtcaggcaattgcttcattctgcacgaaagaataatactgagattatctatatccgccatgatgatggtgtggaattgacaaagggagcagatggatttgatatttttgatgactttgctccattgcctggtgatgagatttttgacaaacactttaacagtgcatttaaaggcactgaactgacagcgtatttacattctaaaaacgaaaatcagattatgattgtggggctgcaaacggattactgcattgatgcaacaattaaatgcggctttgaacatggctttgaaatgatcgttcccgccgattgcaacacaaccgttgcgaatgagtatctatcaggggaacagtcttaccgatattataatgataaaatgtggaacaagcggtatgcaaaatgtctgagctttgatgatgcgctttctatgcttaatggcagtgttcattaatggagttatggaagagatgaaaaaaacaccggaaaaccttggatttacaaggagtttcggtgtttttaacttttattattcctgcgggtaacaggacttgaacctgaaaagaaccacgtagttacaaggaaaattagccgttgtgtgatatttcgtgtgatatcccctcaaaatagcctatcacttttttgttctgctttgctggttcaatatcaatgacattcctgtaaacgctcttcattacgttatcggtttgccatccgcctctttgcattatgtattgatccggtacgccggttgcgtgcatgatggaggctgaatagtggcgcagatcatgaaagcgaaagtgtggaagtttcaatgtctggatagctctctcaaaacgattcgttatctgagacggtttggccttgacaattcttccgtctattccctttatttttgatatcacaaagtccggaaagacaatctgacgataactgctataagtttttggttgcttggtgtgccacaggccatcaggccccagaaccatactcttattaacatctacagtgttcccctttgatgtcatccgatgtaagggcgcatatctctccccggcgcaaaggtccgaatgcccattgcgagtgctgggcggtttttgctatttatttatgacttctcccagttaaaaagacttttacttcatcatattgttcgtaacaatctaattgagttgaaagagtggcacctgcctttaactcgctgtcatcgtcaactacgtaagttgtattattacggattaatatatcgtccttaaaaaataaagcaattacttcaacaaattcagcagcagagtctccattatttgtacatgtgacgattgccttatctggttgttgtgatacatcaacggctatgtctttaatgactgatttgtaattttcgtcttctttaacggataatgtatacttgtacttactaactccagtaactccattataataatcaacggtacatgacgtacagccacttcctagcgcatataattcggaggtgtcagcaccgattatttctccagaagaatttaatgcagtagtattgaaactgatttttacagtcttatcagaattgtttttagcaacgtaaaaataaaagtatcgccgatagaattttcatagctatattctgcgactacactttcatattgcgattgagatatgccagaagaacatccagttaatactaaacccactccaagagttaatagtatttttttcatgattaccgcctaatgcagatattgatagagcatttataaaattattcacccatgtctttagaatttgaagttgaaattatgtccccactatcagcgttgataaattttacagaaacattatcaacagaggtgccattaaagatattatacgtccctccgtacatataaaatgccagtgttgaaaaggattccgctaagcttaaatctgtggattttgtggtaatctcaaattcagtataattgtcattagtttttatgtttataagattggggtaatcttctgagccgatcatgtcttccaatgctgattcaatactggcgttcagttcttccatcatttgtttgtgttgctgtttagtcattacatatgtagcgcttccgtcatcgtgtaaggtgattgatttataccctttttctttgcttgactcatccaattcctcttgcgttttttcttccataaattcagctggaatatcaagctccacgttaaacaatcctttttccacatttacatcgctgatagcttctaatgccccttggatttcactatctgatgaagatgtttcaacagcttgcgcagctgaagcctcagtagtcagttcattattaggtttatcgccgctgttgccacaagctgatataccaataattatagaaccacatagtacaggtagaaataattcttttttcacactcattccctcttttctttgtttttattaaaaagccataagctattttaattgtgcgcatcaaattttatcacatcagcaccatccttatcgttatagaaatcatctcctacaatatgctcaatttcgtgttgataagactttattagctgctcgtggttatgcctggagtttagcatgattgtgtatgtatcatcatcattatgcactgtataggcctttattgtgcgtggcatattaacatattttgtatttacctgttccactcacattccccttccttgcatacacttttacttatttgacattctatctatcatttcttttacaaactgtatatcttccttctttaccttgcgagaagcgtcaaaaaggatcttatattcaggattttcaaacataaattgtgccatttccctggcatcatcatttatatagtatacttcttcattttctttatcttcaccataaaaataagacattggaacattaaagtattcgcatattttctctatcttatctctctttggttcacttttcccgtttttccaatcagatagggtggcagtggatattccggtttctttatggaccctatacggggtaacgcctttttcttctaataacttttcaaatttcttatacataatgacctccgatagtatcacataaatatttctcaaaaagatattggatatgaaagaaaaccgtgataaaagtggggttcgtatctcggaaatgtgttttgttttgctggtaacttgactataacatatttccgatataatttcaaaacttttgcagattatttaacaatgttttataaaaaatgtctcgcgtgtaaggaaacctaaaaaagtgggttactgggttaccgtagccagaaaaccttcattctatgcgggtttgagcggtaacctatgcaaatagaaaacagggttactgtaacctaaaatccggttactgaggtgatgttatgacgaaagaagtgagaaaatatgcggaaaaacgcattctggagagcaatatcagaatggttcccggacattatcctaaatttgagagtaaagagcaagtggacagctgcgagagatcgttcaccggattgcgaaagggtgtgaggaaaatgcctgctaaaagaaaagacagtgctccccaacaggaaaagacttatctctgccatatatgtggcaaggagatccaaggggagcatgtgtacatacaaaccaagagaaagagtaagctgcatatacattttgagtgtatgccaggaaaggaaagtaaaacataaaaagcagggaggtgctgctatggataaagtgcgatattataattcctctatgactttggaggaggcggagcaatacatacagagtggtctgatcacagcggccagggcctatgtggcaaacgggtattatcttcggaggatccgggatgacaaactgtttgaggaatccgggtatcagaattttgaagaatatgtccgcggaaaatataacaaggataaaggctgggcttccaagtgcattaaggttaatcagcagctatctgaaggagggaattcccctattctcagtaagcagtatctggaatatagcacttatcagctggtggagttggcctacatgtcagaggtacagcgggaggaagcagatccggacatgacggtcaatcagctgaaacagatccggaagccggatgaagttgtggagctgaaaaaaagttgtgacgtcacaacttctgagccggaagaagatcaggatccggagcctgttgagacagatacaaccttggaggagttagagaaaaaacgtaaagcggaatggcttatccggtgcgaagttcttaaagaaatgtgtgatgctctttgcgatatgcattcctatggacttgaaaaagaccgatacagcatggcagcaatccaaaggatatcaaacggaaactatggttttggattcggtgatgatgattccggtcatttaaaatacagtgcagattttaagaattcccggtattatgtggaggaattttgcggagatagaaactgggtgtttgaatccgaagagatagatcagtatatctggaactttaatggccgtgaatggcataatgcacatctagaggagcagaagcaggaagcttcttcacaactgaaatcagcttcaagcttcagcggaagcagtaccggcacgaaatgtcagatcaggatcatgaggaattgttggatataagtattcacagcaaagctaagatcatgctttccggatatgattgcgggctatacgaaaggtatttgaaggactggcgtaagttgcagatgccggccagggcgcagaacaacctgcggagagttgaaacgttgtggctgaactttgagtcaaaggcgtgattattcctttagatacttgatacagcacagaaaaaccataacgtaaacaacatacttaaatatttcaagtattggaataatcaaagctaaaaaactgaacatgggaggcctcctgaaattttctttaatacaattatataataacaaattttaaaaagatagcaggcaattcattaagattgtttacaaaattaagattttcaaaaggagtgataccatgagattttacagcttggcaaaaacaaatgcggagcagtttgtaaaagatggaaagaagaatgtgcgcattgcaaaggctaagagaaagaacagccatgttgttcttcttgaagatgaaaagccaacaaaaaactttgaggtgttagaaaagttaaattagaacttgaggaggaacaatgaactgttatagttgttatttttatgatatgaacgatcaatataattcttctggtacctgtgagccacaagatgaggggttccattgcagtcatgagtgcaatctatccaaagaggaggtagtggaagtagaatcactcacaaagcataagcagaccgataagcggtcgtattaagatttttataaggaggtactatgaaatgtggcgaatatgaatatggacagtatctgccgcattcatgtgtttttacatgtaggcatcctgaatgcaaagatgtacccatattcaaaggtaaaacaaaaccgcattgttgtccattaactggcggtaggaaatattttagccatggaaacagaaaacctattgtagaggttcggattcctctgcgtgggtaattaagattttacgaattactgtacattgaaaacttaatattgatagttagtaagtaaggtggtactctataaaaaaagatatagtgaaaggagtaaaattatgatataccttgttcgtcatggtcaaaccgattggaatttattaaaaagattcaacggtattacagatactgaattaaatcaaacaggaataagcttggcaagatcgcaaaatgtaaaattgaaaaatttaagtttggatttgtgttttagtagtccccaaaaaagagcacggcaagcctgcgagataatatacaaaggaattactatatttgatgaacggctttctgaaataaactgtggcgagtttgaaggtataacagaaactttggagacaacaaagttattttggaaagcagtgacgagcggtgataagggtacagaaagtttcaagcattttttgaatcggaattgtgatttttgcggtatgattacggaagaatataagggaaaaaatatcttaattgtaacccatgctgcaaacgcaagagtaataaactattattttactggtaagtccccgattatgatttcagtaaagcagttgcggcaaatggggaaatacttagatatgaaaattaaaagatgaaaactactaactatcagtattaagctggtagttttttaatgcagaaatttaatcaataaaactgatattttcgtgaggaaggtacagattgagaaaattaccaaaagaacgccggatacagtacgtgcaagcgcagggatcaccatggtagaggcagccattgctatgaaggcgcctcctgccaagaccttctctgcaacacatccggcttatacatatacaagcctttgtccggatcctgcgttacgggaaccaccaaagcgaaagagggaggaagaaagtggaatccttccaattctaaaaggacaagctgcaactgtaaggatcatgggcggttgttcgctgtaggtacatattatcagccgaaggcagggggtggagcaggtggcaacaaaaaaactatatacgatatatgacaatggaaagttgataggagaatacagttctctggaagttgcggagctgttacacctgccatgtgccactatttcgtattatgccggttcaggagccaaggcattggggaggtatacctttgaggttgccagagagttggtgttttgcgaggatccgttattcgcagagtgggacaaggtaagaaagcagatattgacgacagggaggtgatagggtgaataaagaaacagcagatcagttagcaagggcggcagccttggagaccgtaaaggaatttgagaagtctcagaagaaaaacagaaaggtcagggtattccagaacgccaagaagctgatggagaattacaaccggatatgccagagcgtccaggagggtgtgtcggagctgtctgatgtggacgatggggaggagctggaggcgttgccggcagaggatatctacataaacagtatcataaaaagcaagctccggagcattgttatgattgcacatattgataaatgcctgggtcttctggaggaggagatgatcaggaaagattggccggagagatacgatgcatttaaacatttttatcttgatgatatgacttatgagcagatggcggaagaatattgatatgcagagcggacggcaaggcgttggattgcagactgtacggtgattttaagcgtatacttgtttggatcagatgcaattgtacttgaatagacttggcagaggtttggcaaaatcgtggccttgtgttggccgtatggccgatttataatagtattatccaaagttgtataaatttggtaatccccctgcggctgccgggtgtaacagtctggcggctgattgattcctgactttctcctaatgaaaacgcctgtggaaatttggttgatgggtgttttctttttccagaatatggtgtataatgcaatagatggcttaggtaaggtagattaatgattaaattatttgtgttaaaaatggaggggattgtatgaagcaaataagaagaatattttatatgacagcgataatatcaactagtttcaccataacatcatttgcaaatcgttataacccagaaactcaagttggaccactgacagaagaagatatacaagatattaatgcagatctggcagaacaggattatttagataatctgccatctatagaatatgatgagaatacggatagttattatgaagacatttatacaaaagcaaagccgggaagctggatgagtaatgatattggaaaatggtaccagttggaaaacggaaattattataaaaatggctgggttagaattgacggaaaacgatatttttttgatgaaaacggctatatgaaaattggttggattcaagtaggaaacaactggtactatactgataatacaggagccatggtaacaggagagcgccggatagatggtgtgacttattattttaatgcatatggaatcatgaaaaattaatggatagatttgattatacacagaggcggctcaatcccgtctcttttcttttggcaagttttggtgtatgatagaagaaaatgtaaagtcaggatgaaaaaaatggcaaaggtaggaatagtaataataacatttattttttgtgtactttttttaattctattgggcttacttgtgagcgctatttttattaaaggatcaaattcattaaagcagagaaaaaaggataaaagggaaggaataattaggtttaattcaattgtacacattggagggttggatacacctaagggttgtatgtgccaggtttatcttaatgcacagcatttatcaatcacttgtggcgggagtgaatttatattaaaattggataaaattaaaaatgcagagtgtcaatgtgatgtaagttggaaaccacgtataaaaactaaaaatgaaaaattggtcactgaaaccaatagagtggtatcatgctttgcaattatatcttatgaaggcacatatggtgatttttctaatatcattttgcgcgatgagtatacgaatacgtatgaatgcagaaggttagtggataaaattaagcctcatttggatcccaagattaggaaggttgagttgtaatatacatagatttttagatagcacagaggcggccaaccccgtctctttttaatacccaaaacaacacaagtgaggtggtgaggcttggcaagagctccagatgaaagaataaaacaggcaaaagctatgtatctgaaaggcttgaaattagttgagattgcaagtcaactaaatctcccggaggggactgcccgaagatggaagtctactcataagtgggataacgaacgttcggataaaaatagcgagcgttcgcataagaaaggtccgccgatcgtgaataagaatgcagtaggaaatgatggcggagccccggaaaagaataagaatgcagttaagacaggagagtttgaaactctcttttttgatgccctggaagaggacgaaaaacggctcattagtttggttcggttagacaaggagcagcttctacttcagaagattcagcttcttacggtccgggagcggcgaatgctgaaacgaattgaagatcttaaacaggccgcagcatgaccatgccatggacgcagtcagatacttttgctatacgatactcaagaacaaaacaatcaagatccggagcaaatctgcttatagattgtattagaaggaggtgagaaacatgtatgtgtacacgatgccccgggaatcctgggacgaactgaatccggataaacaggcgatccgcactctgatcacgaaacacagaaaggaagcctccaggctcaggaaactcatggaatattatgaggggtagcataagatcctgacagaaagccgtaaaacaaagctggtatgtaatcatgcgaaggatatcgcagatacagccagctcttactttatcggaaacaccgtatcctataaaagcaaagcggatattacggctataactgaagcattcgaataggccggggctgatgaagccgatggagacaatggcctagatttatccgtatatggccggacttatgaatatatctacccaggggaatgggaaacggatcttactataaagagcctgtcaccggaaaatacttttatggtctatgatgataccattgaacagaaagaactgtttgctgcttattattatgccagaaaggacgattcggacaaaaagaggaccgtttatattgccacaatcctgacggagcatataagtacgtccggaacattgaagacattataggtcatcagggtcttttagaagaaccggatccttatttctttgaggaaataccagtggtggagtacttaaacaataagctggcaatcggagattacgagcttcaaatcccattgattgatgcttacaatgctttaatgtcggaccgtatcacggatacagatactgatgtcacaagtggcaccacctattattatatagtaagtgcggttaatgcaggcacagaaataagtgattccaatgaagcttccgcagaacctatcgcggatcaaacgcctcccgcaaccgaagctaaattaaaagtagttctagaggtatctgaagcactacgattaagtgtagatgatgatttaaatgtaaatacacaaatggcctggacatcttcagatcagacagtcgctacagtaaatgaaaagggtattgtgacagctttagcacctggtaatactatcataacagtaaaaagtgtagacggctcatatacagattatataaacgtattagttgtagaaaatgcagatgactacagacttgcaattgacttaaatgttggaggcacagctagattaacagcagatgacttcacgaatccaaccaatgttacatgggctcctatggattcatcgatagccaatgtaaccagcaaaggtaaggttactgcacttagtaaaggattagttttaatcactgtaaaagataatgaagggaatattatcggcagggtatacgtaagagtaagggaatagtttgttttagatacagaaaatgcattttataaaggcgggatatccggtattccgggcccgccttttttgaaagtgaattatatcatttctgttcgtgtgataaaattttatttctggtctgaaaaccttagttaatataaggattttcgtgtgatacttgagtgtaaataagtgcttttcaacgcaaaatgctgctttttagtgcaatcataaaataacaaagaccccagtgtttacaaggatttcttgtattcactagggtctttaggcaatgcgggtaacaggacttgaacctgcacggtctcccaccagaacctaaatctggcgcgtctgccaattccgccatacccgctgacgacaacattgatgataccatttgagggtagaaatgtcaagaaaaaggaggcatttttccctggcaaatatgaaacaaaggacaatagatcaattgttggaaatactgctgaaatgttcctcttctaattaatatatgatttaagaaattataatgggagggattaaaggaaaggaacctttgctggaaaaatgaatgctttttggctgatgtcttccttatatatagaaagcttctttgattggataagaatctgtgccgatgtgacaggtgtccggaaatactttaaagacatattatgaatgagtaaagagcgcgacattagtgtaactttcaagggctggataagcggcttcgcaccggccggtataaagggatatggaatgaaagcagacaaatggcaggggaacaacatcgataatggtttgtttagaaataatagtaatgaaataatagggagtgtcagctgctggatgaccacaattaaggggaaaaattattggtttacgacatattgtgttggatatagacttttcaatgtaatgttttaaaacattaattttaaaatatgaaaaataattgttgacttttatcggatgctttggtatgatataactcgccgctgaaaacggcggcaaattttcttctaaaacacatcgatgatcgatgaaaaagctttgaagaaaatgaaaaaaatggttgacaaaaatagacagccatgatatcctataaaagttgctgctgcgacagtaacaaacaaaatgcactttgaaaacagaagattgaacagtatgtaaaaccctgaaaattctaataaaataagccattgtttgatggctttgaatgagaaaattcagaacgaatacaagtaattgtatacgaaccaaacaacaagtaaaacgggaaaaaaattagctagttagttgattttgaccccggattgaaccgaatggcaggtctaagcggtacgctcatgaagctttgcttcattcgctaccatttgcttcgcaaatgttcatagatttgcaaaaaagtccttatgaaagcgagctttcaacagacttttctaccaatctctgaccgctttcaaagactatctgcttaaatttgagagttcgatcctggctcaggatgaacgctggcggcgtgcttaacacatgcaagtcgagcgaagcgatttaaatgaagttttcggatggaatttaaattgactgagcggcggacgggtgagtaacgcgtgggtaacctgcctcatacagggggataacagttggaaacgactgctaataccgcataagcacacagtgccgcatggtacggtgtgaaaaactccggtggtatgagatggacccgcgtctgattaggtagttggtgaggtaacggcccaccaagccgacgatcagtagccgacctgagagggtgaccggccacattgggactgagacacggcccaaactcctacgggaggcagcagtggggaatattggacaatgggggaaaccctgatccagcgacgccgcgtgagtgaagaagtgtttcggcatgtaaagctctatcagcagggaagaaaatgacggtacctgactaagaagccccggctaactacgtgccagcagccgcggtaatacgtagggggcaagcgttatccggatttactgggtgtaaagggagcgtagacggcgatgcaagtctggagtgaaagcccggggctcaaccccgggactgctttggaaactgtgttgctggagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgttggggagcaaagctcttcggtgccgccgctaacgcaataagtattccacctggggagtacgttcgcaagaatgaaactcaaaggaattgacggggacccgcacaagcggtggagcatgtggtttaattcgaagcaacgcgaagaaccttaccaagtcttgacatcggaatgaccggtccgtaacggggccttcccttcggggcattccagacaggtggtgcatggttgtcgtcagctcgtgtcgtgagatgttgggttaagtcccgcaacgagcgcaacccttatccttagtagccagcaagtcaagttgggcactctggggagactgccagggataacctggaggaaggtggggatgacgtcaaatcatcatgccccttatgatttgggctacacacgtgctacaatggcgtaaacaaagggaagcaaaggagtgatccggagcaaaccccaaaaataacgtctcagttcggattgtagtctgcaactcgactacatgaagctggaatcgctagtaatcgcggatcagaatgccgcggtgaatacgttcccgggtcttgtacacaccgcccgtcacaccatgggagttggtaacgcccgaagtcagtgacccaaccgcaaggagggagctgccgaaggcgggactgataactggggtgaagtcgtaacaaggtagccgtatcggaaggtgcggctggatcacctcctttctaaggaagaagaagtaagggttttatatactgttgagtctttggttttcaaaagaagtaaaaaagaataataaggaaacactaagaaagacgtaaaatttctggtgccgatgcgcttaagggagacacccgttcccatcccgaacacgatggttaagacttaagcggccgatggtactatgctggagacggcatgggagagcaggtgggtgccagattatttatggggtgtagctcagttgggagagcacctgccttgcaagcagggggtcaagagttcgaatctctccatctccatttgatgtagttacgaaggtgcacttcgaaaagctgacgcttttctcagtcacggcgttccacgcctatacaatcacataaaaaactgcttatgaacacaagtgttcaacacagttttccatatgattgtgcacgcttctgattacatcgcgcatgtaccttgaaaaccacatattgaaatatatctagatagagtttttatacgtcaaagtataaagacgacatcaagacatccgaggtgttacatcgcaagatgtaaccaaacaaaactcgttaaagtaaccgtaacgtacggtgaaataacaaacctaagaccagagatacaacgctatgtatcttagatgagtcacccgcacccgcaggtgaacatcgaattggttaagctaataagagcgcagggtggatgccttggcactaagagccgatgaaagacgtgataagctgcgaaaagcttcggggaggagcaaatatcctttgatccggagatatctgaatggggaaacccagctgagcaaacctcagttgtcgtatggtgaatccatagccatacgtcgggaacccggggaactgaaacatctaagtacccggaggaaaagaaagaaaactcgatttccaaagtagcggcgagcgaaatggaaagagcctaaaccggtatgcgtgcataccggggttacggactgcaataagtgagacgatttgttaccagaacggtcctggaaagaccggccatagaaagtgaaagccttgtatgggaaagcaatagtcagcgagcaggatccaaagtaccacgagacacgagaaaccttgtgggaattcgggggaccaccccccaaggctaaatactacttagtgaccgatagcgcatagtactgtgaaggaaaggtgaaaaggaccccgggaggggagtgaaagagaacctgaaaccctgtgtttacaagctgtggaaccacattttaagtggaaccgcgtactttttgtagaacggtccggcgagttaccgttactggcaaggttaagcacttataggtgcggagccgaagggaaaccaagtcttaatagggcgaatgagtcagtaaaggtagacccgaaaccgggtgatctacccatgtccaggttgaagtttccgtaaaaggaaatggaggaccgaacgcacatccgttgaaaagggtggcgatgaggtgtgggtaggggagaaattccaatcgaacccggagatagctggttctcctcgaaatagctttagggctagcctcgtattagtctgccggaggtagagcactgaatttcctagggggcgtcaaagcttaccaaagaatatcaaactccgaatgccggccagatgatgtacgggagtcagactgcacgagataagttgggcagtcaaaagggaaagagcccagaccaccagctaaggtcccaaagtgcgtgttaagtggaaaaggatgtgggatttcagagacaactaggatgttggcttagaagcagccacacattcaaagagtgcgtaatagctcactagtcgagaggtcctgcgccgaaaatgtccggggctaaaacacgacaccgaagctgtggaatgtgtattcatacacattggtagaggagcattcttaacgcacagaagcattaccgtaaggagatgtggagtgttaagaagagagaatgccggaatgagtagcgagatggaggtgagaatcctccaggccgaatatctaaggtttccagagtaaagctgatctgctctgggtaagtcggggcctaaggcgaggtcgaaagacgtagtcgatggacaacaggttgaaattcctgtaccgcatatcatcagaactgtggggacacagaaccgaggaagaacccgggaatgaaaagaccggggcaagcattttactggctgggatggaaaatccgcccagcaacaggaaggtgtgacgcgtaccgaacacaagtagggaagtcttcgtaggggctgtcaagaaaagccgctattgtgtgatatgtgcccgtaccgtaaaccgacacaggtggatgaggagagaatcctaaggccggcgggagaagcattgttaaggaactcggcaaaatgaccccgtaacttcgggataaggggtgcctgagaaatcaggccgcagagaataggctcaagcaactgtttagcaaaaacacaggtctatgcaaaaccgaaaggtgaggtatatgggctgacgcctgcccggtgctggaaggttacgaggaggggttagcggcaacgcgaagctctgaatttaagccccagtaaacggcggccgtaactataacggtcctaaggtagcgaaattccttgtcgggtaagttccgacccgcacgaaaggcgtaatgatttgagcgctgtctcgacaatgcacccggtgaaattgaagtaccagtgaagatgctggttacctgcgccaggacggaaagaccccatggagctttactccagcttgatactgggattcggtactgcatgtacaggataggtgggaggctaagaagataggacgccagtcttatcagagccgatgttgggataccacccttgcggtattgggtttctaacctgcagccatgacctggctgggggacaatgtcaggcggggagtttgactggggcggtcgcctccgaaagggtatcggaggcgctcaaaggttccctcagaatggacggaaaccattcgaagagtgcaaaggcataagggagcttgactgcgacaccgacgggtggagcaggtaggaaactaggacttagtgatccggtggtataaagtgggattgccatcgctcaacggataaaagctaccctggggataacaggcttatcactcccaagagttcacatcgacggagtggtttggcacctcgatgtcggctcatcgcatcctggggctgtagtaggtcccaagggttgggctgttcgcccattaaagcggtacgcgagctgggttcagaacgtcgtgagacagttcggtccctatccggcgtgggcgtaggatatttgagaggagctgtccttagtacgagaggaccgggatggactgacctctggtgtatctgttggtgatcaacaccatggcagagtagccaagtcgggaagggataaacgctgaaggcatctaagcgtgaagcccccctcaagatgagatatcccatcgcaagagtaagaccccttgaagacgacgaggtagatagggcagaggtggaagcatggcaacatgtgcagctgactgtcactaataggtcgagggcttaaccaggttggtttaggtaagaggaaagaagaacggatgaagatagatatgtaacaatgtgtggttttgagggtatatgcctcaaaagagaaaagttaaaaagagataagcgcgagtggctcagttggtggagtacgaccttgccaaggtcggggtcgcgggttcgagtcccgtctcgcgctttttttatttgtagcgaaagccttgttttactaaggtttccgctatttttttatgtttgatttcctgtagacgtttgattacttgcagccagttaaagaaattctaagagcctttgggatgaggtcttggattgtgcatgaacaggccttcacttcacttgagacagtttggtccttatccggcgtggtcgtaggatacttgagaggagttgcccttagtacgggtgatcaggctgactgaccgttggtctcatctgccagactaacaaaatatatttattaatcattcctttctgcctttccgaaaatctgattgaatacaaaatagattcccagtttccgggaaaagttttgctgctttcttctatattttttcctcttattcctcaacaatattttcattgcttctacatgcttcaaaagcaagtccttcctttcacaggctgtatggctcttatataaaaaccatacattcttcagccaattagaaagtttgtatcaactcaaaatctgttattccttcactgcgtcattcaatgatcggcaccttttcctattcatacttaataaaaataagtgtgtcaaaatgacacattttagtgcagatatctattgaaaactaataaaataaacaaaagaaatgtataaaataaccaataaaagcgctgaaaatatcaaaaattagttaaattacacaaaaatgaattgcaatgtgtaaggtcaaatgatatactttaaccataaaagcgaaacaaaatcagaccattaaaaatgaaatatcaactgtttgctggcggcacagtagataggaggaacatgcagaaagtaacagagaagcagctgattcacattttagaaactgagttggtaaaagcactgggctgtaccgagcccatagcaattgcatatgcaagtgcaacagcaaaaaagcatctgggggctgtccctgaaaaaattataatatcctgcagcggaaatatcattaaaaatgcaaaagcagtcgtggttcccatgaccggcggtatgaggggaattgaggccgcagccgctgtgggggcagtgggagggaatccggacaaagggctggaagtcctgacaacggtaacagaacaagatttgcagatggcgaagctgatgcttcaggaaaagaagtgccaggtggaaattctggatacaagggaaaagctgcatattgttgtcactatgagacaggaaaaggaccaggtcagggtggagctgctgcggacccatctaggtattatcagaattgagaaaaacgggcaggttctttttgaagagatgcttgcagttgaggaagagcaggcagattacagctgtttggatatggattccatatttgaatttacagaacaggtcaacattcaaaaaataaggaggctgatagaggaacagattgagtgcaataccaatatagcacgtgacgggctttccaattgttacggagcccagattggaaagacacttcttgaagtgtatggagatgacgtgaagatcagagcaaaggcagtggcagctgccgggtctgatgcccgtatgaatggttgtgaattaccggtagtcattaactccggcagtgggaatcagggaatgacggtatctcttccggtcatagaatatgcgaaaacgctcagaagcagtgaagaagagctatatcgcgcgctggtgctcagcaacctgattgctatttatcagaaataccgtatgggcagattatcggcttattgcggagcggtcagtgcggcagcgggagcaggggccgggatcacctatttaatgggaggagcaagggaacagatcgagcatacgattatcaatactctggcaaatacttcaggaatcgtatgtgatggagcgagtgcttcctgtgcggccaagatcgcttccagtgtggacgcggcaattatggccagctatttatccatgaacggacatgtttttcttccgggagaaggaattgtaaaagagaacgttcaaaagacagtggatggggtcgttacactggctaaggatgggatgaaagaaacggatgaggtaatccttaacattatggttcagggttcataaaaacaactcagataagagaaaggaaggtagtttcagttatgaaaaaggggtttatcaggtattcattggctatgatgatgttggcaggtgtgttggctggctgcaaccagggaagtgggcagagtgctgggggaacccagaatacttctgatgcacaatcaggaggagtaaaggctcaggaaggggaagaggccataaagattgcagtggcagcgcctatgacaggggataattccgaatatggaatcggttttaccaatgcggcgaagcttatggctgaccagtggaatgagcagggggagttctgggaaagaaaattgaaatcgtcccctatgatgataaaaatacttccgaagaggcgacgaccattgcccagaagattgtttccgacggtgatatcagcggtgttatcggacacttttcttccggagtctgtatgacggcggctcccatttacgaggaaaataaaatcattgagatttctccgtcagcttcccacccggattattccaaaataggaaactatatcttcagaaataataccatcatatccaaggaaggagcagcttctgttgatatagccgtccatgaccttggaaagaaaaatatcggcattatttctattatgacagactggggaaccaatacatcaggtatcatcaaggacctgattgcagacctaaatgatcctaatgtaaaagtagtcgcccatgaagaagtaatggaagggtctgatgactatacaccggcaatcaccaagctgaacgaggcaggagcagatgtggtgatctgctgcggcatgtataatctggtggctccggttgcgaagcagtataagaacattaatcctgatattgccatcgtgggattttccaatgcttacagccagcagctgatccagctgggcggggaagccgtagagggagtctgtttcccggttattttcttctcggaatctgatgacccggatgtaaaggcttatgttgataagttcacacaagcctatggcagcgcaccgtctgctcttacttcccaggcctatgactctgtgggaatccttctcacagccataaaagaggctggtaccacggattctgaagcagtaaggggcaagcttaatgaaatcacctataagggcgttaccggcgataccaagttcgacgagcagggagatgttgacaagcagtttaacaaggttacgatcaaggacgggaaatttgtgaagatgaactagtttaagcggcgggaatggtgatttgctgttcccgcagaaaggtgaatatatgattgcacaacagatatttaacggactggcactgggaatgggatatgctctcattgcagtcggatattcattggtattcggaattctcagactggtcaacttttcccatggttctgtctatgcatttggcgctcagatggcaatgattttcattggactccggttcggaatcattccagggctcattgccagcatggtgctgacaggggttctgggtgtggcaattgacaagcttgctctggaacctctcagaaagaagaaatccattcccattgcctcattgattacgaccattggaatttccaacattgtgactaaccttctcattgcaattttcggaagtgaaaaaagagcatttcctgccctgtttgacttcgggaccctgcagattggaaaaattgtcatttcctctacccagatcgggatgtgtgcggtttccctgatcctgatgctggttttggttggcattgtattttatacaaaaatcggcctggcaatgagggcggcagagcagaatcccaaggctgccaatctaatgggcatcaatgtaaattttgtaatttcatttactttcttcttaagcggcatatcagctgcgattgcaggctccctggttggaagctattaccagatcgtctaccccaatatgggatttatggcaggattaaaggcatttgcggcagcggtgcttggagggatcggaagccttccgggggcgattataggaggtctgatagttggagtgtcggaatcaatggctgccaccgttctgggatccacttatcgggattccatggcatttatcatattgattattgttctgatcgtaaggcccaatggtttgttcggaaagaaagggatcacgaaggtataaaatatgacaaatacaacaattgaaaaacacagctttttatttcagttagaaagctttgtgagaaaatatcagaaaatacttttgatcctgctggcggtatttttgtgcttgcttccaaagggagtgaacaatcagtatttcctgactgtgattgtaaaaatggcggtatatgccatgtttggtcttggtcttaacattctgaccggttacaccggcctggtttctctgggacatgcgggatttgttgccatcggggcatatacggcttctttatgcgcggtaaagctgggctggagtttttttccgtccatgctgcttggcatggtgaccgcgggactggtaggaatccttctggggcttcccacccttcgcctgacaggaacctacctttctattgttaccctggggtttggggaaattattaaaatgattgccatgaactggtcagccgttaccaatgggacccttggagtaaagaatattcccaaacccgccatatttggcgtgaagctcaccatagcaaatcatgggctgtattatctggtcatggtcatactgatcatctgtacggttttctgtcttgttctcattaagtccaaaaccggcagggcgcttcaggcgatcaagggggacgagctggccagcattatgatgggaatcaacaccacctactataaaatcctggcttttgtattatcggcatgtatctgtgctgcggcaggagcgctgtatgcgacgctcatcggatatgtggatcccaatacctttaattttgacgtatcaactctgattctttccattgtgattctgggaggtatgggaaccatcagaggaatgtttcttggggcagccattcttatcgcgcttccggaggtgtcccggttcctaatggtttaccggttcgttttatacggcgtgatcctggttgtcatgatgcgcttccggcctcagggaatccttgggtggaaatcccagcttccttataaattatcaaagaaggtattggaaaagcttaagacagcggatacagaggaggcgggaaccaatggctgaaaatggatatttatccgtaaagggaattacgaagcggtttggcggtatcgttgcggtggaagaagtgagctttgaggtaaataaaggggaagtggtttccatcatcgggcctaacggcgccggaaagacaacggtattcaacatgctgacaggtgtgtacccggtggatgaaggaacaattgtatttgatggagatgagatacagaataaaaagccaaagcatatcgtgatggcgggaatgtcccggaccttccagaatatccgcctgtttcaggacatgcgtgtgatagaaaatgtattgattggagcccacataaaaacctcatacagcttttttgactccacattccgtacggccagataccgggaagaggaggatgaaaaggtacttgaggccatagagcttttacggtccataggcctggaaggcagaaaggatgattatgcatccaatttaccctatggagaccagagaaaactggaaatcgcaagagccattgccaccggcgccaggctgcttttgctggatgagccggcggcaggcatgaatcccagggaatctgaggagctgatgctgtttatccgctctctgaaacaaaagggatacaccgtattgctgattgaacatgatatgagcgtagtgatgaatatttctgacaggatctacgtgatcgaccacggcaaacccattgcccaggggcttccgatggaaattgcaaacaatgaacgggtaattgaggcttatttgggaggtgtacataaggatgctgaagataactgatttaaatacttattacggtcccatacatgcgctcaagggtgttgatatggagatagacaaaggggaagtcgtatctctcatcggaagcaatggagccgggaaatccaccctgttaaatacgattgtgggaatcaccaggtcttcccggggacgggttgagtttatgggaaaggaaattaccaacagtccgccctatttcatgacaaagctggggatcagcatttctccggaaggcagagaagtatttccggcgcttacggtggaagaaaatctccgccttggcgcctacacagtaaaggataaaagtaaaataaccgacagttatgaacgggtctatgagatattccccaggctgaaggagcggattaaacagacggcaggaactctttccggaggggagcagcagatgcttgccattggaagagccttgatgtgcaacccggaactgcttttgttagatgagccttccctgggacttgctcccaactttgtactgctgatttttgatctgatcaaagagataaataagcagggcgtgaccattcttctcattgaacagaacgccaacatggctttgagcgcttcccacagggcgtatgtgctggaaaatgggaaggtcaccatgtcagggaatgcaaaggagattgcgtctgatccaagaattaaaaaagcgtatttgggcttaggataaaggaggtaacatgaaaaagataataaacaaaccgatggatgtagtggcagaggcattgcggggaatggagcttgcccatccggagcttcggtatacgccgggctatgaagtggtttcccgcagggaaaaggcagataaggtggctgtcatatcaggaggcggtgccggacatgagccggctcatgcaggatatgtaggaaaaggcatgctggatgcggctgtatccgggaatgtattttcctcaccaagcccggaccggatcggtgaggccatcaatcagatggattccgggaaaggagtccttctgatcataaaaaattattccggggatattatgaacttcggtcttgcctccgaccttgcagaagcagaggatatagaagtggatagcgtagttgttaaggatgatgtggctgttcccgacagcacctactccaccggaagaagagggatcgcgggtactgtattcgtacataaaattgctggagcaagggcggagcttggaggaagcttacaggaagtaaaggcggcggctgagaaagccatttccaatataagaagtatgggcatggccatgagtccgtgtattcttcctgcagtgggaaagcctggatttattttgaaagaagatgaaattgagatcggaatgggcatccacggagagccgggagtggaaagaaccaggattaaaacagcaaaggagacctctgaaattcttcttgagaagattcttgaagattatgattatacgggcagcgaagtggcggtgctggtaaacggcttaggcgggacccctcttatggagctttatatcctgaacatggaaatccagaagctgttggaagaaaagaagatcagcgcttataagacatttgtggggaattatatgacggcccttgacatgaccggctgttccctgacgctcatgaaactggatgacgagctaaaggagctgcttgacacaccctgcgatactccggctctgaaaatcaaataaggcggtggaatatgggatttgaattaacaggtaaggactacgcagagtacataaaaaaagcatatgacctgatccatgaaaatggagaatatgtgactgaactggatctggctaccggcgacggcgaccactggtcaaacattaacatgggctttgaaaagctggtcgaaaaagctgatgagctgggggaaatgtccatcagtgatgaattaaaggagatcggtaagatcatgatggccgtgatcgggggatcctccggtgtgctttacggctccgcatatcttggggcagccaaggcacttaagggaagggaggtcctggactgccagggagtatgcgacatgctggaggctatgctggaagcgatcatgtccaggggacaggcaaaggaaggctttaaaaccatgatagacagcctttctccggcggtaaatgcatataagaaagggatttctgaagggaaaggcgagctggaaatctgcgaaatggtgaaacgggcagctattgacggagccgagaacacaaagaacatggaggcagtaagaggcagggccacctatcaggccaacaaaggcctgggacatctggacccgggagccgttaccatgtcttatcagatcggcacgttaatgaattgcataaaagaaaaaatcaatatttaaggaggtacagtgatgtacagcaacataccggaagacagaggtcagcacatcaaggatttgagggatgggatcgagcacagagccacatggttctactacatgtttatggaagcgaaaaagagaggccttgacagtgactttgcccacgaagccattagaaaatgcggatgcttccatggagagaacaaatatacccagaccagtgacttaaaggtttttgaaaaggaattcatcagtgacaatgtaagaaatatctttcagatggatacggaatgtaccgatgaacagctggatattacattccactactgtccgctggtggctgcatggagaaagctaacggatgatgaggaactgatcgctgaaatgtgcgaaatcgccatggatggggacaggggatatgctcccagtttaaggactttaacttccaccttggaaaaaccattgcaaaaggggatttcatctgtgaagtgacctttaaaaagaaccaggaataaagaaacggatttactttccggaccaaaagggttgttgtatcaatgcagcatccctgtttggcgtttaaaaaacggatattgtggggtgtgggagatggaaaaaagcctgttaggattaatcgaaagctataccaatcattttgcaaggatcatttcggatacattggacacagacattcttattatcgatacaaatatgaaaattgtgggcagcgcctttaaatatttaaatctttatacggatataaaaatcggtaccattatttccaccatccttttggaaaacagaaatgtgatcgtggaagacaagtcccgcctgcccggctgccgccggtgcgatcagttcagggagtgcaagatgagcagttttgtaggggtgcccataagggttgaaaaccaggttgtgggtgcgcttgctttaattttaaccaggcacagggcgaaattcctgtttgaaagcctggattctactgtctcgtttttagaaaattttgccgaacttctgtccggaaaaattgaaaatgagacaaaaacaattggacttcaaaaccgcctgaaagaaatagaagctattatggataagatgtttgaggcggtcatttatacggactattacggaaatatcattcatgtaaaccagcgtttttgcgatatcattcattttgacagaggattgaccggcagaaacatgaaggagctgtttccgtttcaattaatagaggattattttcagtcttatgaagatatcagcaatgaaaggctgatctttgagatgaaggattatttatttcatggagtggtatccagtaagaagatatacttaagtgatacggaattcagtaccttgttttatttcaggcctcaaagtgattttgtgaaaaggatcaacatttccgaacaaggctctcttgtgactttggaatggcttaaaaaatatttttcaaggcaggaactggatcgggccaggacgctggctaaaacggatcaccatattctgatccagagttctgataacgagctgaatctccttcttgccaaagcagtatttaatacttcggaaagaaatctccatgatctgtatgtggtttatgcggataatttatacagggatttatttgaaatatatatgatggatgaatacggtctcttaaaaaatgccgataactgtaccatagtcattgtacagccggaaaacatgccgatctacattcagaattatctgtcagatttcataaaaacaggcaagtttaaatcccataacaagctgatccgttccaatgtaaggtttctgttctgtactgacagggagctggagcctttggtggaacaaaagctgttttccccggaattatatcgccttatggttttacataaaatcacagtggaaggaatggaaatggatttggtgaagttccggtactatgtgaattcagggctggtttattataagagtctctataataacagaacggttgaactgtcaggagaagttataacatatttcaggaaccattattcggaaatagggaagcataatatggaactcattcttgaacggatcgccggggagtgttccgggagagtgagtgttgaggaactgaaggaaaagaatctgctcaggcagaaagatgaggtgttttgcgggcttggagaaactgcgagagaacggataaaggcaatgcttgacaggggatattccaaaacagatattgcagatgtgcttgggatttcccgttccaccttataccggaagataaaagagtatggtgtggagtgaacttactattgtttcccttttttcttgtctattgattgaaactatggtatgatgcacttggttagcgtaaactaacttgctgcggccttcatgggtattgagaaatatgttgacatccctttaattctttgaggtaaaaaacgatgagtatacaaaaaattttagatttttataatcattcctctgttaaggttcatgatgtactgcatataagccacgaaccggggactcattacgccggaccaacgacggaaggtcattatggcctgatattcaccgtggccggaaacggaaagatgcagtttaatgaagcaaagggagtcgcaggaaataattcggtttttcatggagggcctgactgcttacatagaggcgcactgcattcaggacctggatgtacgttccattgccagactctttggcattaaagaaagcagactgtactatttattccgcaaattttctgatatgggtccggcaggttaccaacagacctgcaggttaaagcaggctgctgcactgcttacccttatgatgctgactgttatactgtctggctgcgggaaacaatcccccggcaatacgcctgccgtgacacaagaagatagaagcagttcatcttctgatttaagatcccggaatacacaaattacagatacaaaaacatatattgatctggcaggcagaactgtggatataccggttcagccggaacgaattgttgcggtaaatatggccggagagttaattgcactgggaataacccccgtggcggtatcagatggctggcttcaatatctggacaatgagcaaaaaaagaacattgaatcaatcggcgccgttggaagccttaatctggaaaagattgtggaacttgatccggatctgattattacaccacaaaaggtgacggcagatgaaactttggctgcattggaaaaaattgctcccacagtggtaggcccattttttggagatgcactgaataatttaaggatgatgggagatgttgtgggcagatcatatgaggcggaggcttggctggaagagtttgaattcaatttaaaagcaattaatgaaacactggcaagtgttgtgaataacggcgaaacagccatggttattcagtttactcagaaaaacatgtatacctatcctgtcagcacctttcctgtggtctatgaatatcttggactgagtgtaccgtcaaaagatatttctgaattaaccaaatccatgcagctatccctggaagtcctgccggagtatgacccggattacatatttgtcacaaaggtaaccgatgaggacgacgaatatattcaggcaatatttgaaaattctgtatggaagcaattacgtgcagtccaaaatggacatgtgtatgtgcttggctctcgtttatcgtctggtgatgtgttgtctgtaaaatggtccttagaagagattcagcgtttgatggcagcagaatgagacccaataaagctattataaaagatggaggcaagccaacgaaaagggtccgatgagtgataaggccggctattacttagagcctggctgcccgttttgccgattttatgatcgctgtccgctgcggagctattatcagatacgggacgccggagcaggttatgacaccggaggttttgcgggataccttccgcattaacgcagaaattgtgaaggaaccccgcaccggacgtcccacctgcatttcctacaaccttattccggagatatcaagcaagtgtgacatttgagaaagagtgtattgacacataacatattttattcgaaaagaaggaataacagcaaagccctgaccgtatccatgccagccgtgccggttattccacattttgtaaggtgatgatcatttcctgttcagaaaccgcctcagtaaactgcacggagtaggaatacccttcagcctgccaaaccgcaattttatacttactggcatcccctttcaatgtgaaaagggtgccattgaccgttacgttttttatatcggtgtatacggaataatctccgctgacatcctcacttcgggcagccattctgaacacaagggtattgttccggccaatggatcgtatttcagccagctctttccagtaagcggtatattgtactgtctccacttcaaagggaatattctgtatttcctttacggtaaatccaacggcttttgacagctcgttggcagaatggtattccacaatatccggtattgcctgctgtgtaggttccctggtccaattgatcctgttttgaacgagaaaagaaccaaccaatagtatgacgaaacaagcggcaatggaaaggtactttttgtaattgggaaaaggcatgattttatctggaatttgattcaaatcaagcctgttaatattgtttaagatccgatcacgcatatccgtggtgacttcaatgtgattcatcactttgccatacctattcttcaaaatcgtacacctccttcagtacctctttaagctttattctggccctcaggagcaaggaacgaaccgttgcttccttctttgacaacagcgaagctatttgagctgtagaatatccctcgtaataaaaaagatgaacaacttctctgtattttgatggcagcagcttcactgcatcccacacaaaactcagatcctccgtctcatttgccgctaaagtatcgcttagttcatcggttttccggatcttattataggtgattttatttttgctgatatttattgcgacacgcagaacccatgccttttcgtggttaaccgtctcaaacctgggctgttttttgataaattgtatgagtgtatcctgcaatacatcctctgcatcactcatattatgcagataagagtatgccaggcgcagaacgttgttcccatagtcggtcatgattcgcccggcttgctggctgatctgcgcagaaggcagtgccttctccctggatgctgcttttttcctgctttccggtgcctctccgtaaaggacaaagcacagcagcaaattcataagcttttttaaaaaactgaaacattcccacagcctgtttggcagcatatatatttcaaacatacagtccctccttggatagggatttggtgatatttatcgaagaccgctgcctgttcgtcaatgtcaccctctgcttttacactgctaatcatatcgctgatttcctgattgtcaagaccttctcccccgggatttacagaaacagcaaaggtgtatggaccttcaatccaggtggcaacatttacctttccgtcactgcctttggttgatactgccaggctgcctacaatcatagtgttgctttcatcgtattcgttgtaatcaccgctgatatcttcactgccttttctctggcgaaaggttatctcattttcaccttttgtataaatgagctgcaccattccgccctttactgcctggattttatccagggaatagtcggcgggaatgctggaaggaatccttggggtgaaaccggcaattttcccggcttctgcaatggtcttacagtctataaaaggattgggaatttgcaggttattgtctttggcagactgaccgcctgtctgccaggcgttatcctttgcgggagtattgtttgcgcaggcacaaaaggataatgccgtgacggcgcagagtgtaattgcaataagttttttcataatgattcttcctttctgttttcatggcttgtcagggcctgtgtagtaaccgctttttatgcggctgtaatatatacagactggaacaggataatgttgcatgaaaaaaatcacgactttttgggaaatccatggagagatatccgtaaatcaagggaattgaaaaagattgctgcattgtatgttataagagaaaggaagaatgcataatatttgcagtttaaacctgcttacgatataatcaatcaatatagaggtgatgtgtatgtttaaaataggggagttttccaaattgactcaggtatccatccgaatgttaagatattacgatgaaaccgggctgttaaagccagcggaaacagacaaatttacaagctacaggctctattccatagaacaaattcctgttttgaataaaatcatattcttacgggatttaggattttctgtttctgagatcacggatgcccttgatcattgggatgatgaatttatagcaaaccggcttgacaataaacggctggagattgaggaggcgataaaagctgagttggacaggctgtctaaaattgaactggcaaaaagagatattttacaggaaaagatcgggatccattataatgttaccattaaatcaatacccagctgtcaggtgttttctttaaggcgggtcgttccggattattatgccgagggcaggctgtggcaggaaatgtcgtcctttgcagaggaaaataatattccggtttcaaccaatacctttgcagtttatcatgacacagattataaggaaagggacgttgatattgaaatatgcgctcccgtaacccgcatgggaaaggatatgtgcggttttacctatagaaatacagaacctgttccaatcatggcatgtactatggtatatgggccttttcataacataaagggtgcatatcttgcttttgcaggctggctgcaggcccataaccaatacaaaatgaggggacagagcaggcagattgtccatcgcggcccctggaatgagggctgtcctgacaactatctgactgaaattcaaataccattggagaaaatatgagctgacaagcgttctggggagtttgcaggacgctttttactttataagaagttccataaaagcccaaaatagtgtataatagaaggtgaaataaagatttgcatgacaaaagagcgaatgaagattcgccatggctttgtacatgaagtcagaccaggaaagcaggcagaaataaaatagtaaagaaaagccattgttacaagtatccctaagataaaaagctgccgtcagaaagaaaggagaaatgtatggataaaagatttggaggccaagaggattcgagcaatcgaaaaccggaaaatttcgaaaaacttccaagaaaaaagcagataaagatgattttaagaggcatataccttatgataggagtggtactggctgctttcttattttccaacagcttttatacgttgaccgaggataaggttgctgtagtatgtacctttggtacccctgtcagcgtgacaaagacgggacctcattttaagattccatttatacagacagtttacaagatgtcaaaagaaatcaaaggcatgaggatcggctatgacgaagaaaatcaatcaaccatcagtgaatccgaaatgatcacaaaagattttaattttgttaatgttgacttctatatagaatatcaggtggttgatccggtcagagcgtatatttaccgtgacaatgctgtggatatcttaaaaaatctttcccagtcttatatcagagataccgttggtatctataatgtagatgaggtgatcaccacgggaaaagctgaaatacaagcaaaagtaaaacagcttctttctgaacggttggaaaaagaagatattggcatcggtattaataacgtaaccatacaggactcagaaccgcctacaaaggaagtcagcaatgcatttaaggcagtggaagatgcaaagcagagtatggatacgaagatcaacgaagcaaaaaaatatcagtccgagcagctcccggcagcaaatgccagagcagataaagcaaaaaaggatgcggaagcctacaagcagcaaagaattagtgaagcagaaggtcaggtatcaagatttaacgatatgtacgaggaatatataaagtacccattgattacaaaaaagagaatgttttacgagaccatggaaaatattctgccttctttgaaggttattatcgacggatcagatgaaacacaaaaagtccttcccttagaaccctttgtgagcagtgagaaaggagaagaagaataatggttaaaaaaataaaatatgcagttattattctgcttttactatttataggtttcaattcccttgttgtcacaaaggcagacgaatacacattaatcaagcagtttggtaaggttatgcgtgtggagaataccgccggtctgtcttttaaaactccttttgttcaaagtacacagaggattccaagaaaaaaaatgatctatgatctcattcccagtgatgttacgaccagggataaaaaagtgatgaatgttgactccttcgtgatctgggaaatcacagatccggttaaatatttatcttcgttaaatgcaagcattgaaaaggccgaggtaaggcttgacaatgttgtatataattccattaaaacggttatgtctgcaaccagtcaggaagatattatttcaggcagggccggagaacttgcaaatgcaattacaaacaatataggaacttccatggactcttatggaattcacatccttgctgtagaaacaaaaaagctggatctgccagattccaataaagagtctgtataccaacgtatgatctctgaaaggaataatattgcagctcagtatacagcagacggggattatcagtcttctctgatccataacgaaacggataaaacaacaaaagagactgtagcaaaggcggaagcagaagcagaaatgattaaggcagaaggagaagcacagtatatgcagattcttagcaacgcatataatgatgagtccaaagcggatttttacaactacgtccgctcactggatgctttaaaggcttcattaaagggtaccaataagacaattattttgaataaagacagtgaacttgcaagaattttgtctggaaattaacgaaatcttcaggggcttgagagtgcggaagatacctttttattattgactctcacatggtgtgagggtctacactggatttgcaggtgaattaataataatatggaggtatgaattatgcagaattttaaggtaagccctatcggcaaaatcaacgtgaaccatgaaggaatgtttattgaactggaaccaaagtttattcccgggctgcaggcactggacggattcagccatatcaatgtgatctggtggttcagtgattttagcagcggggaagcaagaagtactctggaaacgccccagccttataaaaaagctccgtctgtcatgggagtatttgccaccaggtcaccggttcgccccaatcctattgcgttaactgcggcacaggtcctttataccgacttctcaaaaggcatcattcagattgcttatattgatgccaatgacggaacccctgtgcttgatataaagccgtacacaccaagccttgacagagttgaaaagcccggcgtgccggattggtgctgccattggcctgaaagtttagaggaatcaggagaatttaattgggaaaatgaatttaatttttaaggcatttcggcagtaatcaataaaaaaacaaactctctttggcacaggaaggtcaagacttttccagaatttgcctccaactatgaataagcgggacggatttgttgtatacaggcatttaagaatgtggtaaaatgcagatatatcaagataaccaggaaatttaaagcccatttggcagccttgtagatatcctgctatacagaaactatgatgggtagcaaaaattactcagcagaagataaggaggagcatatgttggataaggtgattacaattagccgggagtttggaagcggaggacgagagctgggcatgaagctggctgaaaggctggagcttccattctatgataaggaactgatttctttgtcagcggaagagattgatttggcggaggaggcagttttgcattatgacgaacatgtcacaatccagcaggagccttcggaacagaagttttattctcccttttctatggtgtacgaggtttccatgtcagaccagatttttctggctcagtcccgtgtgatacggaagctggcggaccagggaccttgtatcattgtgggacgctgtgcggacagggttcttgaaaacagcattaatttgtttgtatatgccaagatggaaaacaggattaaacggataaattctcttgaaacaggcgtaagtcctgaattgatggaggaaaggatccgggaaatagataataagcgaaaggattactaccagtattacacgggatgcgaatgggggaaggctcagaattaccacctttgtctggaaagcagcctggtaggggtggaaggctgcctaaatgcttccatggcttatttacaatgcttcgtttaaatacagtaaagcgaattgcgttcaaatcataaaatggaaaattttggaaggaaatgtaagaatattgtaaacgatagcttccaaaatggatggtataatgtaacaaaaaaaggagtgttaggaaatgatgaaatgggcaggaaaaggatataaaggtcttattgcagccgttcttgtcattgcattggcggcgtcttccaatgttacagggtatgcagagcccataaccggtccgggtgccaacattgccgcaggcaattccggttccacgaataatgtgaccatatatgtgagcaagagaacaaagacgctttctctaaagcagaatggagtcctgatcgcggaatatccggtttctctgggcgcgtcctcgtcggaaggaaataaaaagatagagggcgatatgagaacacccagcggggagttctatgtatgcaccagaaatgataagagtgtagcttatctggcattgggcctttcctatccggccattaaagatgcggaaagaggatatgctgacggtattatcacagaagcccagagagatgaaatcgtgaaagccaatttagaaggaaggcagccgccttgggatacgccccttggaggtgccataatgattcatggctgcagggttcctgacggaaccacccagggctgtgtggcagtggacaacagtaccatggatgttttatggagttactgcaatttaggcgtaccggttactataggaccataagaaaatttccccaaatatgcggttttaagccgtttttggggattttttcaatgtctgtccttgtattataacggccgttgtactataatagacgaaattatgataaattacggaagacagaggtgaggaagacccatgcatttttcagagagaatgaatcgttttggagaaggcatcttttccaaactgctggaaataaagaggcagaaagaagaaaagggagaaccggtaattgatttaggcgtgggcgcaccgaatattccgccggcaaagcacataacagacgcattgtgccgggcggcggctgatccgaaaaattacgtatatgccatccgggaccaaaaggagcttttagaggctgcggcccaatggtatcacagaagatatggagtagatttagacccctctcttgagatctgttctttgctgggttctcaggaaggacttgcccatattgccctttctgttgtggatgaaggcgatgtggtgcttgttccggacccctgttatccggtgtttgcggacggccctgtgctggcaggagccagccttttttacatggctcagaaacgggagaacggttatctcatcgattttaaggacattccggaagaggttgcaaaaaaggcaaagctcatgatcgtttcttatcccaacaatcccactgctgccgttgccccggattctttttatgaggaactggtggcctttgccagggagcatgatattctggtccttcacgacaatgcttacagcgagctggtttttgacggcagggaatgcgggagctttctcaaatttcccggagcaaaagaggtgggggtggaatttaattccctttccaaaacctatggactggcaggtgccaggatcggtttttgtttgggaaacagagaggttgtcggcagattaaaaacccttaaatccaatatggactacgggatgtttcttcccatccaacaggcggccattgcagccatcactggcgaccagagttgtgtccgggagaccagacacgcttatgaacggcgcaggaatgctctctgtgacagcatgacccggatcggctggaggatggaaaaaccggaggcgaccatgtttgtgtgggccaggataccaaaagggtttgatgactccttctcatttgccatggagctggcagaaaagtcaggggttttggtaactcccggcagcgcttttgggccttctggggagggatatgcaagactggcccttgtccaggatgaagaagtgcttaagaaagccgccgaaatggtggaaaaaagcggaattttgaggaaacagccatgaaaaagaaaagaatatggacggtagtgaccctgctttatgtcctgttcatattttccaattccatgaaaccatcggaaatctcatcagctgacagcggctgggtgcttcgggtggttcaggaagcattcgtatccctggggatcagtgccgggtggctgacagagcacattatccgcaaagcagggcatttttcagaatacaccttattggggatattgctgtatggatgcgtaaagtcctatgaatttccggcagaaagaagatattttatccgttttacggcaggttttatggtaccctttgtggatgagaccatccagttgatggtagaggggcgttcgggacagatatctgatgtatggctggattgcgggggagtggctttcggaatactgttggccgctttatcgctacaatatagaagaaagtcgggaaaagtatgataaaaaattatcgaatggtcctggaatatgacggaagccgctatgacggctggcagaagcagggaaatacagaacaaacgatacagggaaaagtggaacatgttttagagcggatgaccggacaggcagtggaggtacatgggtcgggacggacggacgcaggggtgcatgcattggcccaggtggcaaatttttactcagatgtgaaaatgaagccggaggaagtaaaggaatatctaaaccagtaccttcccgaggacattcgggtgaatacggtggaatttgcacaggaacgctttcacagccgccttcatgcccaggaaaaaacgtatctctaccggatcgagacaggcgcaaaaaagcaggtgtttgaaagaaaatacatttatggcttatccaagactcttaatataaaggccatggaacaggccgcctccttgctcataggagaacatgattttaaaagcttttgctctaacaggaagatgaaaaaatctacggtcagagttttaaacagaattgaattccaacagcagggaagccgtgttctgatacggtataccggaaacggctttttatataatatggtcaggatcttaactggaaccttaattgaggtggggttagggcagcgtaaggcagaagaattgaaggaaatcctggaggcaaaggaccggagtgcagcagggtttacggcgccgccggaagggctttttcttgaacaggtgcgctataaagagtcaaatactccacaataagctgcggggtattgccttttcgggagtaatagatggtaaaggagttatatgacagaatttttggttaggacatttgtaaaggattataaaaatacagaagatacgcaggtgcggacccggtacggacttatggccagtgttgtggggatctgctgcaatgtcatattgtttgtctccaagctttttattggaatgctggtaaacagtatctctgttatggcagatgcttttaacaacctttctgatgccgcttcttccattgtgggatttgttggtgtgaaaatggccggaaagccggcagatgaagaccatcccttcggacacggaagagtggagtacattgctgcttttattgtggcctttttggtcattcaggtgggcttttcttttttaaagacctccattgaaaaaatcattcatccggaagagatgacgtttaaggccgtgtctttggccattttactgttatctgtctgtataaagctgtggatggcgctttttaacaatactttgggaaaaaggatccattccactgtcatgaaggccacagcagcggattcccttggagatgtgatcactacttcagccaccatcctgtccatcctggtttatggaatattgggacttaatattgacgggatcatagggcttgtggtttcctgtattgtcatgtgggcaggagtgaagattgccaaagatactcttaccccgctcattggagaacccattgatcccaagttatatgatgagatcacggaatttgtagaaagctatgacgggatcgtaggaacccacgatttaattgttcataactacggcccttccagaagcatggcatccattcatgcggaggtgcctaatgatgttaatatagaagtatcccatgagattattgatgccattgaaagagaagcagtaagaaaatttgggatatttcttgtgatccatatggatccggtggaaacaaaggattccagggtcatggaatttggcagcatgctggaaaatgtgctccagaaaatagatcccaggatttctttccacgatttacgtatggtggaaggaaagaacaagatcagcctgattttcgatctggtggttccacgggaatatgacaagaacaagaaagattgtctaaaggaagaagtcacgaaaaaggtaactgaaatagataaacggtgctgtctgatcataacggcggaaagcggttttggggtggaaaaataaggtaataaaaattttccagtttatgcaataagatgacagtattccgcattaacttagtagaaaggaaatcggatccatgctatttatgggattgatgagccttggcgggcctgaggattacggccgtttgagcgacgaagagcttcttagaaaagttgcagttggagaccaggaggcctttcggcagctatatcagaatacggaccggacaatgtatagctttatcctgtccattgtaaggcaccccaggatgcggaggagatcatgcaggaggtctatcttaagatctggacttctgcgtcaggctataaatcccaggggaagcctttggcatggatgtttaccattgcccggaatttatgctatatgaaatttcgggaacaaaaacatgattcggatgttacgctggaggatttaaccggagcagaaacgggagaagtctgctcagaaattgaaatggcggcagataaaatggtgcttctggccgctttgcagattcttaaggaagaggagagggagatcgttctccttcatacctcaggaggcatgaagcacagagagattgccgccagccttaagattcctttggctacagccctttccagatataaccgtgcaatgaaaaaattggaaaattatttgagagaggagtaggctttgatatggctgacttagatcgcagacaattgaatagacaacagattgaagcctgcttaaaatctgcggccaggaacttaactcctaatgttctggaacggattgacttgagtacgcctcagataaaggcagagaaggaaacccgttctgttttcttcttaaggcagagaattcttgcaaccttggtggctgcatgcttttgcatgatcgccctggctgggggaacctatacttatcagaatggaaaagtggattcggtcattggaatcgatgtaaatccgagtgtggaattatccgtgaataaaagaaataaggtcctgtcagcaaaggctcttaatgaggacgcggaaagcatcatgcaggacatggatttaaagggtgtggacttaaatacggccgtcaatgctgtgatcggtgccatggttacccatgggtttttcagcgacctggataatgctgtcctggtcaccgtatccaatgacagcatcagcaaggcttccagcttacgctttgcagtggtaaatgacatccagaataccctggagcaaaaccagttaaaggcagtggtatatgaccagcaggtgatggaagaggacgaagtaaaacggctggcagaggaatataatatctcttacggaaaagcttactttttaagggaactgatcctgcagaattcttcccttaccatggaagacatgagggagctggcccctctgacaatggaagaaatcgcgaaagtgataacagaacgctcttatgcggtaggcggcaagacaggtgcagaggaggaaaccagccaggcacacacgacccaggttaccaccacagcggctcctgaaacggcggaggaaagctctgcttcagaggagtccacaacaacggcttcttcctcagaaacggaaagccagactccggtgcagccttcccagacccagccggctacgaccgcgactgccacggcagaagaaaccagctcaggggaggaagtttcttcaacggaaaagatcaagatagactatgtggactatgacagcggtgttgtcatggtaaactttaaaaccaaagtaaagtggaaaaatcccacggtttcagtaaacgacggagatgggaatgcttattccgccaaggtgggagatacggattcctattcctgtgagatccatgtaacaggtcttcaagggggaatggaatatacctttaccttaggcggcatttctcctaagatcggaaagcagacaacggttaagggagtttttgaaacgcctgtgatcggagacggaaatgcagatccggatataacggaagaagagagcgaagagacggagcagacggacccagccatggaaagcacgtctgagacaacaaaggatgagacggaaacaggaaagaatccttcccaggaagaaacacatacatcaaaaagccaggaagagccaacgaaaacgggcagctcttcctgatgagcagcgtttggaaatatctttttaaaatgttaaaaaatgcttgaccggagtggaaagctatagtataatacattcgttgcactgatgggctatcgccaaatggtaaggcaacggactctgactccgtcatttcaaggttcgaatccttgtagcccagtgattaaaataaaccagtaattacaaggagattcttgtacttactggttttttcgtgtttgtattgattttaattcaatgcttcgatcagtgaaatcagagccaatgactgtccgtaggccatggggcgaatggtaatatttttataatgatctgcatcatagcccattccggttcctgcggaaacatttaaaacggttccatcttctcctatgtttttgcatatcgcttttattgcccggtctgcacattcatggtatgattcatcgagaatgcccatttttatcccttttaatataccgccggcgattgctcccgtaccggatacttcttcgtagcttgcaggatccataaggacggtattccataaaccagatggggcctgtaagtcttttaaagcatttacctgggctttataggtatctgtcaggtaagtgagaagacctttatcaagagttccttcataggactcaataaactccagaattccataggtaaaccaggaattgcctctgcaccagaagattcctccgaaattattatttaacggaaaactccagccgtgataaaataatcccgtatgtttgtcgtataagtatttgatatgtaataatacctgatgaagagcctcgctgatccactcctgattctggaaccgatggcccattttatttaaaaacagaactgccatgaataacgtatcaatccacatttccccatggtttaacaggacgccgtcccggtttccgatggcagttaccacatgctggaagccgccttcctttgtttttggaagcccggtcatcagccagcgggcgtgatccagacataacttttcgtattccgggtttttaagagtatcaagcagttcggctaaaaccagatagggggcagtggtattgatatttttactgggaagttctttctttaaattgttttcaaaccagttatcaaaaaattctaagtaacggttatctccgtaaaacctttgaagctttaaaaggccatagaggcctacgccctgaggccagtcccattcttcgatgccaaaatctctggcaatgatgccccggcttgcgtcctcctttcctacggagcggtcgttttcatagtcgccccctcccagattcatcagtttgtccatcacaagatggatttttggcagtaattctttgtttgtcatgtcattctcctccgtttaactttttagcatatgcgctaggtgtcatccccgtgttttttttgaaaatctggctgaaatactggggattatttccacatcccacctgctgggcaacccattgaatttgttcggtatggccttctgccaataactgcttggctttttggatgcgcagggtagtaatgtagtttgagaatttttgttttgtttccttgctgaaccgtttgctgacataatccacattcatgaaaaggtaactttcagcgatgcatttcaatgtaagattgggattatccagatgttcttctacatactgcatgaccttttcaataaaaggactgtatcgctgagaatggctggacggttcttttaaaacctcgttaagtttttcacataacatggcgcggatgccggaagtttcattctgctggtttaaatccattaaatattccgtagtgtctacggatgaaagatagctgctttccgtagcaaatttaattagaatccgtgaacctgcctgctttaaaaagtcggggttagtgatgtcgtttaaaattgcagtaagttcatccagacgtgatttcagcgctgaaccgtctgcatgaatcaaaagtgtggtcagctcttcgattttggaaatcaaatttttataattgcaggtggggaccggctgcagtccattcataaaatagatgattccgtaacgtttgatctttgtaatcagggtttctaaaagctttcccaggcctgaaaaggtaaaacgtttataatccagttccacagattgtgctttcggatttaagctttgcatgaaggaatccaatggatcataggagacctggtatccttcaaaaaacagaatcagggagtttcttacatagatacagtataattcgataccaggtgcatgttcggccatgtaatcgtaaatgcagcttaaaacagagataaaatgatcttcttccagatagtggagaaaacacatttcatatcctgtattatagaaatccataaacccggaataggcgttccagacaaattctgcaggttcaggcagaaaaatcatttcgttgattatatttgccagaatgctgtggtgtaagttggcagtcagcgccttctggcgttctctcaaatcctgaaacgcctggcggtgatagtattcctggatcacatcccgcatgctttccatgatttgctcctcattgcatggcttgagaagataatgatgaacccggtatttcatcgcctgttttgcatattcaaattctccaaagccagacagaaggataaactgggtatccatatcggcctgggaaatacgttctaccaattccaatccagacaggccgggcatccgaatgtcagtcataacaatgtcaggcgattcatcaagaatcatgttataggcctcaatgccgtcgcggcaggttccgatcagttcgatgcccaggctgttccagtcaatgagggaagaaatagactcccggatcattcgttcatcatcagcaataattaatttcagcatttgcgctctcctttcgtatcagaaatggcatgaagagtaggatttaagggaaaagatagctgggcgacggcctggtcttcctcattatagagggtaagtccgtagttctccccataagtaagctccattcgctccagaatatttaaaagaccgattccaaaaccatgaggttcaattttgtgtgttttcagtttctttaaaaggtcgtcttcaaaaaaggaactgttatttttaacagaaacaaaaagggtggaaccatctgattcagctacaatctgaatccggcattcctccgtattttcctccaatccatagcggatggcattttccaccagtggctggagagtcagtttcagcacagcacatccgaagagatgctggggagcggatatctcatattccagcctgtcctcataccggtatttctggattgtcatatagcattgcacaagctccagctcccggcttaaaggaacttctttgtatttctggtccagagtaatgcgaaggagagtgcccagggattctgtcatggaagaaatatcttttgccccaatggtctttgccctccagttgatggattccagggtgttgtacaaaaagtgaggattcatctgagtttccagggcttttagctgggcttcttttatcaggatttcatttaagtagttggtccggatcagttggtttactttattaaccatctggtcgaagcaggagtgcagaatgcccaattcatcggtacgtttgctgtaatcgtaggaaatctgcggtgtttcggtctgccctgccgcaaagcgttccatttttaatagcagattgtcaaaatgccttgtaatagaatcaatcaaagcagaggagagcaggatggccagccctatggagactgtaatgattgtcaggcagatttttaagctggtacggagggaatccgcgatgcttccatatggtatcagacaaacataatcccagtcaaattccggtatgataccttttacgtaaaagaagctgtttccatcaggatttacaagaccgtatctggaatggaaaaagttttcaaaaagtggcatctcgttggcctttaaactggaggagttatagatcaagtcctcctgaccgtaaagaatataacgggtgtcatcataaaagtggctggtgccggtggctgccttgatcagtccgtcaatatttaagctgacaacaagcgttcccagagaatcaagacttaaatattccgacctccgcagattcttgaccataaacaggccgtattcatcgctgtagtcggtaatccagagagtacgtccctttgcattttcgcctcttgtgacaaggtcctgagtgacggcttccggaagagtattttccgctgagatatgggtatgaatggaaaaccgatcctgatatagactcataaagttaatattgtttttccggaaggaaaaataatattcatttaaagttccgtaaagagctttgtatgcaatggtacggtcctgaacgctggaagaatcctttaaagtcccaagtccgttttggataatggtatcagccagaaacatatcggccatggtggaaacattgtccagccggttattcagctctttggcagtataggataaggaggaggccacagattgatagagcactttttggtgggccttggaaaccagatgaatactgaacagagaaacgaaggccaaaaggataatgcaaagaaatacaatagaatgaatcttcttttttaaagagagatttctgataaactgcttcataaagaaccgcctttcgcatactgaactgatgacagctaaattatatataaaacatctcagcaaaacaaccggttagggaaaagaactattcaaattatacagataacacggttttttcaacttggaacccggttttactcatttactggaataatcgtgggaagtataatgaaaacgcttaatacagcaaaagtaaatgaatggaggaaggtttcatgaagaaaagaattgcgttactattggcggcagctatggcagcagcttcacttgccggatgcggaggcggcacatccacaactgcagatactacagcaggctccgctgcagaagatactactgcagcaagtgcaggaaatacaggcggagatgctaagctgaccatgagctggtggggaaatcaggtcagaaacgagaaaactcaggctgcattggacttgtattcggagcagaacccggggataatcatagaaggacagttttccgagtggtctgattactggaataaactggctacttccgcagctggacaggcgattccggatcttgttcagatggattattcgtttattgatcaatatgtaaaaaacggactgctggtagatttaaagccgtatatggaagacggtactctggatgtctccaacatttctgacaacaccatagccagcggtacggtaaatgacggggtatacgcgatctgtgcgggaattaatgcaccctctctgctgtataataaaactctgctggaagaaaacggcattgaaatcaaggattacatgactacggatgaattccttgatgtatgccgtcaggtttatgaaaaaacagggtataaaacaaacattgcctattataatgcgggagcttatctggattatttcatgagaagctatgacattgttctctatggagacaaaaagatgggcggaaccgcaaacgattatcttccatttttccagatgtatgagacaggaattaaggaaggctggtttattgatccaggtgtatttgcagagctttccatcggttccgttgaacaggagcctctggtttacggctcaggtcctgaaaccatgtcctggtgtgctttttacaactctaatcagctgactgctattcagaaagcagctcctgagggtatggaaatcggtattaccacctggccgtcagcagatccgaagaaatctggttatttaaaatccagcatgtttttctctgtcggcgctcatacaaagaatccggaagaggcagttaaggttctgaacttcctgaccaactccagcgaggcaaacaacattctgctgggtgaaagaggagttccggcctccagtgttatttccgaagagcttgcacccaagatgagtgatgtggatcaggaagtgatccgttatatcaatgaggttgtaactcctaattgttctcccatcaatccgccccagccagacggcgcaagtgaggtttccaatttgttaaatcaggtccaggaacagctgtgctacggcgcatatgatgcagctacagccgcagaagaattctttaacggggccaataatattatgagcaaaaagtaaatgaacccaatcaggtggagtacaaactccacctgataagcagcgaagcggattgccgaagtccgcttgactaagtatacagttatccatgaatggaggatgtctatgaaagataacaaaggtgcaggactcaggcatttcctgaacaaagaaagtacagcgggagtgatattcagccttccgtttatcgtaggctttctgttgttcatggtggtgcccatgggaatttccttttactattctttatgcgattataacattttgtcgccgcctgtttttgcagggcttaaaaattacataaaaatgtttaccgatgataaagtgttttttcagaccataggggttacgttttatttcgccttagtatcggttcctctgcgtttggtttttgcacttatggtggccatgcttctgcttaatacatcaaaagcaaccggattttaccgggcggcttactatcttccatccattatcggaggctccgtggcagtcgccattctttggaagcgaatgtttgcaaccgacggtgtgatcaatcatcttttgggtattttggggattcagaccagctttgcatggctaggaaataaaaatacagcgatttggacccttattatcctggcagtctggcagtttggttcttctatgctgattttcttatcatctttaaagcagattccggtgaccctttatgaggctgccagagtagacggcgcaaataaagtttctcagtttttcaagatcactttgcctctgttaacacccactattttctttaatctggtgatgcagatgatcaacggtttcctggcattcacacaatgctttatcattacccaaggaaaaccgctgaattccactttgttttataccgtttatatgtaccagcaatcctttgagttctataataccggatacggggcagctttggcctgggtaatgctgggaattataggtttcataacaatgattctgttcgcaacaaagaaattctgggtttatacggaaggagtgtgagacagatgaaaacaaaaagaaaaataggaaaagttttttaccatgttattgtctgcagtctggggcttgtgatgatttatcctttgatttggatggtcatgagttcttttaaggaaaccaataccatctttataacagcaggccagctgattccggaaaagtttgtgctttctaattatatgaacggctggaaaggctttgcaaagattacttttgctactttttttaagaattctctgtttatagccgttgtagcgactttgggaacggtattttcctctgctttggtggcctatggccttgccagatgcagattttttggcagaagagttttgtttgtagcaatgctgctctctatgatgctcccggctcaggttctgatgatcccacagtatttatggtatcagaaattagggtgggtaggaagctataagccgctgatacttccttattgctttgcaattcaggggttctttgtttatctgatgattaatttcatagatggaatccccaaagagcttgacgaggcagccaagattgacggttgctcttattatagtatattttccaggatcatcatgccccttatttccccggcacttattacggccagtattttttcctttatgtggagatgggatgattttctttctgctctgctttatatcaatgagtccgccaaatatccggtcagccttgcattaaaattgtttagtgatcctggatcttcttccgattacggtgcaatgtttgcaatggcaaccctatccattctgcctgcagtcattatctttatctgcctgcagaaatatctggtggaaggcatcagtacttccggtttaaaggggtaatacgcaactctttttttaaaaattacaaaaaagcgatgaaaaaggagaatgaatatggtcattgataatgttccaagacctgattttataagagaggattggacggatctgaatggagaatgggatttttcctttgatgaaccggtatttgaccggaaaatccaggtgccgttctgctatcagtctgaaatgagcggaatcggggatacagaggttcaccatatagtatggtatcggaaagcttttgtggtggagaaagacagattaaatggaaaaagtctgcttttgaagtttggagctgtggattatgaagcagaagtttatattaatcaaatccatgcagttggccacagaggtggtcatactccctttgaggcagatattaccgggctggtatcggacggaaaaaacatcataacggttaaggttatggattacagtgacgcggataagccgagaggaaagcagacatggacaggggagaattttgcctgctggtatactcctaccaccggcatctggcagagcgtatggctggaatatgcgggaaaaccctatataaaacgaataaaggcaactccggatctggaacggaatgaagcattatgcgaaatcttcatttcatccatggaccgtgttgaaggagaaatagcctttcacagcctccctgcggaaggtggtatggaaatggatctgggcagcttaaaaatttcctgtgaaaatggctatggaaaggggattttggctttacctgacttggatctgcgccgggatcagctgacatggacgccggaaaagcctaatttgattgaaatggaggtaaatcttccaaatgataaggttaccagctatttcggacttcggtctgtttgcgttacaaatggaaaaattctgttaaacggagaggttttgtatcaaagactggttcttgatcagggctactggagtcaaagccttcttacgcctccggatgaggaatccatccggaatgatatactgctctcaaagaaaatgggatttaacggggccaggaaacatcagaaagttgaagatccaagatattattactgggctgataagctgggatttcttgtatggggagagatgccaagctgctatatgtatacagacaatactgtggaaaacacctctaaagaactgactgaattcattgaacgggattataatcatccttccattattacatgggtgacagcgaacgaaagctggggaatgagaaacataaaaacggataacagccagcagagcttttctaatatgctgttttatcaggccaaggccctggatagaaccaggctggtcagcggaaacgacggctgggagcagacggagcacacggatattctggccttgcatgattatgaactgatgccggaaacggaaagaaagtatgattccatggaagatatcctaaatagccatgcggagcgccgctttgttctggcggatcaggaggcgtaccggggacagcctgtcctgatgacagagtatggcggtattgccttttctgcagaagaaaaaggctggggatattataataaggtgaaaagcgaagaggaatttttaagacgcctggagcctattacggatttcctgattaaaagcagaaagttctccggtttttgctatacccagcttacggatgtgatgcaggagacaaacggtcttctgaaagaagacagaacgcccaagctttcatttgaaaaactggaaaagattttcgggaaaaaaatctacgaataagaattcttctgccgtccaaatgaacggtaactctttcatggccggcagaaaaatcgacttaaaaaagacttgactaatgtagaaaaatcttgtataattcctcttgttgtattgatgggctatcgccaaatggtaaggcaacggactctgactccgtcattttcaaggttcgaatccttgtagcccagtctgaaaacggaacctcatggggttccgttttttgcattgcagattgttaagttcttgttaaaactttcctttttgatagaatttccccgaaaacgctcacagggttctttctggtttatctggacaagagcttaaaaatgctttataatgttatataattttgatgagaggtgtgaaatgtatacatttggcagcagggtccgttacagtgaaacagacgagtgcggaagactgacattaacaggcatcatgaattatctgcaggattgctctacgtttcagtcagaggacatcggccttggaatttcctacttaacggatcgacataaggcctggtggctttcctcctggcagatcgtggtggaccgttatcccgtgctgggggaggagatcgtagtgggtacctggccctatgactttaaggggttttacggctaccggaattttaccatatgtgatcaggccggagagtaccttgtaagggctaattccgtatggttcctctttgatacggaaaagggacgtcccgttaaaattgaaccggaagacatcaggggatatggaaacggcagggaaacgcagctttccatggactatgcttcccgtaagatccagttgccggaggaatatgagaacacagagccggtcatcgtcggaaagcatcatattgacacaaaccatcatgtcaataatgctcaatatgtagagattgccagagaggtgcttcccgatgaagtggaggtatccgaactgagagtggaatataaaaaggcggcagtctttggagatgcaatttatccccgtgtgagccggacagaggaaggttatactgtttccctgtgcgatgagcggggagcagcttacgcagtcatctggctgcgtggaacaacagagaggatgtaacatgatagaattaggaaagatgcagaccctggtggtacaaagggtcaaggagttcggtgtatatgtgggcgaggaggctgaaagccaggtttccgtgctcctgcctaaaaagcaggtgccggaggggaccgggcccggtgacaggatccctgtttttatctataaggattcagaggaccggctcatagccaccacagcagtgcctaagcttttggtaggtgaaaccgctgtgcttcaggtgaaagaagtgggtaaaatcggcgcatttctcgacatgggacttgaaaaggatctgctccttccttttaaggaacagacccataaggttcggccgggagaaaaggtgctggtggctctgtacattgataaaagcaaacgattggcggctaccatgagggtatattcctatatgagcaatcagtcgccctataaaaaggatgatcaggtgaccgggatcatttatgagatgaatgagaatctgggagcctttgtagcagtagatcataagtactacgggctcatcccccggaaagaggtttttgaaaactaccgggaaggtgatgaaataacggcccgggtcaccaaggtaagggaagacgggaaactggatctaagccccaggcaaaaggcatatatccagatggatgcggattccgaaaaggttcttgagatcatagaaacacagtttggcggaagccttccgtttaccgataaggcagagccggagatcatcaaacgggagttttccatgagcaagaacgcgtttaagcgggcagtaggccaccttctgaaagaaggaaaaatcaagataacggaaagtaaaattgaaagaatcagataacgggtaaaaaggataacaggaggattattttggactcgatagactattataataagtatgcagcaaaggaatttgaagaaacagtgaaccaggatatgtcgggggtcatgaaggaattcttaaatcttctggaggaaggcgatacgattctggatttaggatgcggatcaggcagggacagcctgactttctatgatctgggatatgatgtgacgccgcttgatgcatcggaggagatgtgtaagctggctgaaatccataccggcctggaagtgcttcagatgacgtttgaacagatggattttgacaatgtgtttgatggaatctgggcctgcgcatccttacttcacattccgaaaaaggaactgtctgacattcttacaaagatagcaagggccttaaatgataagggaatcctttatatgtcttttaaactgggagattatgaaggattcagaggaaaaaggtatttctgtgattttacggcggattctattacggaagtgttaagggataacggccggtttgagatcgtaaagctttgggaaacagaggatgttcgttctggtcattctgacgtaaaatggctgaacgttcttgtaagaaagcaatagtaacacgtataaaatttacaagacggtgccaaaattattggcgccgtcttgtagtttctgactaaaactgaggggcaatatcggtaacctatcgaatatagacagaaatatcagaacgattctcttgatattttgacgtttcaatcatttttttgacccgttatacaaattagccaaaaggccgaaatggattttggtaaataacaatatggtaaaagaaaaataattcatgtatgattgtttcagaacaaagggccgcagctatgggggctgccggttcagatcagagaataaacactttattttaggaggattagtaaatggctagtttatcactgaaaaacatcgtcaagagatatcctaacggatttgaagcagttaaagattttaatctggatattgctgataaggaatttgtcattttcgtaggaccatccggatgtggtaagtccacaaccctgcgtatgattgcaggtctggaagacatttcttccggtgaactttacattgacggaaaattaatgaatgatgtagagccaaaggacagagatatcgcaatggtattccagaactacgctttgtatcctcatatgactgtattcgataacatggcgtttggtctgaaattgagaaagactccaaaggacgagattgataagctggttcatgaagctgcaagaatccttgaccttgagcatttattagaccgtaagccaaaagctttatccggcggacagagacagcgtgttgccatgggacgtgctatcgtgcgtgatccaaaggtcttcttaatggatgagcccttatccaaccttgatgccaagctgagaggccagatgcgtattgagatttccaagctgcatcagagacttcaggcgaccatcatctacgtaacccatgaccagacagaggctatgacacttggtaccagaatcgtagtaatgaaggatggcgttatccagcaggttgactctcctcagaacttatacgataagccaggtaacaaattcgttgccggatttatcggtgctcctcagatgaacctgattgaagcttccgtagcaaagaagggaagcgatgttactttaacattcggcggaaatacaatcgctcttcctgaaggaaaagcgaaaaagttggaggatgccggttatgtcggaaagtctgtagtcttaggcattcgtccggaagatttacatgatgaggaagctttccttgagtcttctcccgcaagtgttatcagtgctaccatcagagtttacgagctgttaggtgctgaagtttacttatactttgatgtggaagatgtaaactttaccgcaagagtaaatcctcgtacaacagcaagacctggcgatacaattaagctggctcttgacttaacaaagatccatgtgttcgataaagatacagaaatcgttgttttaaactaaaaattaatgaaattttaagcaagcggttaacctacccgcttgctttttttttctttttgcattaatatataataaggtaaatttacgaaaaaggagaatatgccatgatttcgaatcaaatacttcaaacaaccattgaaggattaaaagggattacgagaattgatctgtgtatttgtgatacagaaggaaaggtattggcaaccacatttcctgatgcggaagattatgaaagttcaatcctggcgttcgtggattctccggccgacagccaggtaatccagggatatcagtttttcaaagtgttagatgagcaccagctggagtacatcctccttgcaaagggaggaagcgatgatgtttatatggtaggcaaactggcggctttccagatccagagcctgctggttgcgtataaagaaagatttgacaaggataacttcattaagaacttattacttgacaatctgcttttggtggatatctacaatcgggcgaaaaagctccatattgagacaaacatcaagagagtcgtattcatcatcgagacacagcatgaaaaagatgtaaatgcattggagacagtgcgcaatttatttgccgcaaagacaaaagatttcgttaccgccgttgatgagaagaatatcattcttgtgaaagaggtaaaggaaggcgagacttacgaggatttagagaagactgccaacaccgttttggacatgctcaataccgaagcaatgactcaggtccatgtagcttttggtaccattgtcagtgagatcaaagaggtttccagatcttataaggaagccaagatggcaatggatgtgggtaagatcttctacagcaataagaatgtggttgcctatagtaaactgggaatcggacgtttgatttatcagcttccgctgcccttatgccgtatgttcatcaaagagattttcgacggaaaatccccggacgattttgacgaggaaactctgacaacgatcaataaattctttgagaacagcttaaacgtgtctgaaacttccagacagctttatattcacagaaacacccttgtttaccgtctggacaaactccagaagagcaccggcctggatctgcgcgtatttgaagatgccatcacctttaagattgccctgatggtagtgaaatacatgaaatatatggaaaaccaggactattaatttttacgttaccaagaacagtggaaagagaggcagtaatacagctgttttgcgcttaagcagaagcagttgtattgctgactcttttcataaggcgaagcctgttccccaaaagcaaaagtaatcaaagcacaaaatttagaggactgaaatgattgaactttggaatgtaagcaaaacatatgaagccggaaacaaggcgctgcgcaatatcagcatgaccattgaggatggggaattcgtgttcatcattggccgcagcggttcaggcaaatccacacttttaaaaatgcttttaaaagaagtggagccaaccaccggcaaaattgtcgtgaatgatatgaatttaagcaagatgcccagaaagttcattcccaaataccggcggaagcttggcatggttttccaggatttccggctgttaaaggatcggaatgtctacgaaaacgtagcttttgcacagcgggtgatcggcgcatctacaaggaacataagagagtcggttcccgccatgcttaaaatggtgggactatcttcaaaatacaaattttttcctcagcagctgtccggcggagagcaacagcgtgttgccattgccagggctttgattaaccgcccggaaatcctgctggcggacgagcctaccggaaacttagatgggcacaactccatggagatcatgaagctcttaaatgaggtcaataagctgggaacaacggtgatcgttgtcacccatagccaggagattgtggaccggatgaaaaaacgggtggttgtgatggaccgtggggccatcataagcgacgagaaaaaaggcggttatacatatgagaattagtacgttttggtattgcctgaagcaaggtgtaaataatatatgcaggaacattttgttttccctggcttccattgcaacagtttccgcctgcatctttttgttctgcctgtttttctccattgttatcaatgtgcagtatgtgattaagaatacggaaagcacggtgggaatcacggtgttttttaatgatgggctggatgccaataagatcaaggagatcggcaatgagatcaaagccagagatgatgtgaaggaagtgacctttacctcggcagaggaggcatgggcggaagcaaagcaggaatacttcggcgacttgcaggacctagcggaaggatttgaggaagacaatcccctggccaattcagcctcatataccatatttttaaaggatctggtggatcaggatcaggtggtggactggctgaagagtcttgacggtgtcaggaaagtcaattattccaaaacagcggcagaaggcatgaacagcttaagcaaggtgatcggagttctttccatgctgatcatcggtgttttattggctgtggccatattcttaatcagcaacaccatttcagtggcagcggccttccggaagagtgaaaaccagatcatgaaattaattggtgctaccaactacatgatccgggcgccttttgtggtggagggcgttatcatcggactggtgggagcttccattcctcttattgccatttattttctgtaccggtctacagttgagtatgtggtcacaaagttcagcatcttatccggactgtttcagtttctgccggtggaggccatattcccatatatggcggcaactgcgctggctcttggtgttggaatcggattttttgtaagcttctttaccatcaggaagcatctgaaagtgtaggaaaaaagcaccctgattttaactgcagggaatatagaggcagcattgctgcatatgataggaaaatgccggagagtgatatccggtccagaaaaaattctaagctttccagttagggaaaacagattgaggccgatcagaaagccagaaccccggagaaaggcagaaaaggcggggaaagcggggaagcaggccatgaaaacgtataatacggttgctatggggaatattaattttatatggctctgcccgcagttaagcaggagcgtttcagacgccggtgcttttgcaggcagaggcatcttccctcctttttccgggaacagcggccaaacctacatacagttattctgccggcatatatcatgattcctcatgatggaggtgtttatgccgtttctttgcattgcttccggcttttggtattaagccggaagtttggcaggggcagataattgcaaatgtgggttataccggatattccacaaggccgtatctccattttgagatcagggcagatggcagctatgcaaaccggtgaaatacgcaagcccataaagagctagataggagaataacagtggaaagtaagaataaattttggaagggcgccctagtaggagcgcttctgaccacattggcaggtcttgttattgtgggaatgtctctcgggatctttctgatcggcagggcagccattgacggaaaaggtcaggcagctgaatccgctcaggcagagaaccaggaaggcagccttgatatgaaccggatcgtgaacaaaatccagacgatccagagcgtgattgataaatattatctctttgatgaaaatacaaaaaatgtggaagactggatctataaggggatgctctatggattagaggacccttatacggtttattatactgcagacgagtatgagaagctgatggaggacactgccggggaatactgcggaatcggagtcatggtcagccagagcgctgccactggaatcattacggtgacaaaggtctttgaaggaacgcctggggctgaagcaggaatgctgcccggtgacatgatttataaggtaggcgatgaagaagtgaccggtatggatctggaactggttgtaaaggaccatatcaaaggggcggaaggaacgccggtaacggtaacggttcttcgtccggatacgggggcctacattgatatgactatggagcggcgccagatcacagttcctactgttgagcatgaaatgctggcagacaatatcggatatatatcggtcagccagtttgatacggttacagcgggtcagtttaagagtgccattgatgacctggaaaaacagggaatggagaaaatgatcgtggatttgagaaataatcctggggagtcgtggatgcagtagtttccatgcttgattacattcttcccgacgatctgttgattgaaggtgatcccaatctggtaagaaccaagaagaataaaacgcttcttgtttatatggcggataaaaatggagatggagagcagtattacgcctctgacggccataaagtagatgtgcctatggctgttttggtcaacggccagtcagccagcgcttctgaagtgttttccggagctcttaaggcttatgacagggcaaaactggttggaacaaagacctttggaaagggaatcgttcagactctgtttcctcttgatcatggtactgccattaagatgacggttgcccattactatacgccaagcggctttgaccttcatggaaaaggcctggagccggatattgcggttgatctaaaagaggatttaaaaacaaagattaaaatagagcatagcgaagacaaccagcttggggaagccataaaagcattgaatgaaaaacgttaaattgtaaaagaaaaagccctctaaggcaggccattttgaccactgtccttagagggcttttcaatcagcaggtttccagaagactgataaaccggcggcaggcttcttcgctggtagcccaggaggtgaccagacggacggaggtatggctgtcatccacccgttcctgaacgatgaaaagaaaatccttttccagctttgcgatcacctggtcaggaaggatggggaaaagctggtttgtcatggaatcggaaaggaagggatacccgcacttttcaatcccttttctcaaaatggcagacatttcattggcgtgggctgccagatcatagaggaggttgttggaaaacagctcttcaaactggattcccagcagccagccttttgccagcatggctccccgctgtttgatcataaaccggaagtccggttttaaatcctggtgacagatcacaagggcttctccaaacaaggctccgcccttagttccgccaatgtaaaaaacgtcggtgagctttgcaatatcttccaatgttaaatcattcacagagcttgtgagcgcagaaccaagacgtgcaccatccaggaataagtaaagacctttctggcggcagatgtggtgaagggattccagttcctttttggtatactgtgtaccgatctccgtggaattggagatatagaccattttcggctgtaccatatgctcgtccgtatgaaggtccaaagccttctggatgtgggctggagtcagttttccatcctcgcagggcatggctatgaccttatgtcccgtggcttcaatggctcctgtttcgtggacatttatatgccccatgtccgtggagatgaccgcctgccaggggcgcagggcagtgctgatggtgatcagattggtctgggtgccgcccactatgaaatgaatatccgcatcctcccggccgatttcttttctaatgagggcgcgggcattgctgcagtggtcatccagtccgtatccggcattctgaattaagttggcattgatcatggcctccaaaatttttggatgtgcaccttcgctgtagtcgttaataaaactgtacataaaaatcctcctgctgtttcatagtatgatatatcaaaagtgttccttactttcgatagtataacttatccgaacttgcgacgcaagttcggataaaaggggcgttctttgccccgtccatccgattatcgaaagtgttccttactttcgataatataagatgtatgatatactaaaagcaagagaatttcaataccaaaagaacagatgttccctgttttgctatacttttttattgccgtatgctataattggcagtgacgtatattgtaattcctgcaaaaagctatataccgggcggatatggttgcatgttcatttggcggctgcctgcgggaaatgatttggaggtaaatgatcatggactttgtattgcattcagaatatgcccctaccggtgaccagccccaggccattgaacagcttgtaaagggattccaggagggaaaccagtttcagactctgcttggggtcacaggctctggaaagacctttaccatggcaaatgtgatccagaagctgcagaggcccactcttatcatcgctcataataagacgcttgcagcccagctttacagtgagttcaaggagtttttcccggaaaatgcggtggagtattttgtttcctattatgattattaccagccggaggcatatgtgccttccactgatacctatatagaaaaggattcagccattaatgatgagatcgacaagctgcggcactcggctacggctgctctctcggagcggaaggatgttatcatcgtggcatcggtttcctgtatatacggcctgggaagtcccattgattatcaggaaatggttatttcattaagaccaggcatgataaaggacagggatgaggtggtccataagctgattgacatccaatatgaccggaatgacatggatttcaggcgtgggaccttccgggtaagaggagatgtggtggagatatttcctgcctattccggaagcgaggcttaccggatcgagtttttcggagacgaagtggagcgcatcacggagatcgataccctgacaggggagattcgggcggaattgggacatgtggccatattccctgcttcccattatgtggtgtccagggagaagatggagctggctgcacagaccatcctggaggaattaaaggagcaggtggcgtattttaaaagcgaggacaagctgttagaggctcagcggatttccgagcggacgaactttgatgtggagatgatgaaagaaaccggcttttgttccggaatcgagaattattccaggcatttgaccggaggacagcccggagagccgccctataccctgattgattattttcccgatgactttctgatcatcgtggatgagtcccatatcacccttcctcaggtacggggcatgtttgcaggggaccgctccagaaagaccacccttgtgaattttggtttccgtcttccctctgcccttgataaccggcctttgaattttgaggaatttgagtcaaagatcaatcagatgatgtttgtttctgccactccttctgtctatgaggcgaatcatgagctgttaagggtggagcagatcatccggcctaccgggcttctggatcctgaaatcgatgtaaggccggtggaaggacagatcgacgacctggtttctgaggtaaataaggaagttgccaagaaaaacaagattctgatcactaccctgaccaaacggatggcagaggatctgaccgattacatgagagaagtggggatccgggtaaaatacctccattccgatattgatactctggagcgttccgaaatcatccgggacatgcgtctggatgtgtttgatgtgctggtgggaatcaatctgctgagggagggtcttgatattccggagatcactctggtggctattctggatgcggataaagaagggtttctccgatcagagacttctttgatccagaccataggaagggcggcaagaaattccgatggccatgtgatcatgtatgcagatacggtgacagattccatgcgtgtggctattgaggagaccaaccgtaggagagccattcagcagctttataatgaagagcatgggatcaccccaaccaccatcaaaaaatcggtccgtgaccttattgccatctcaaaggcagccattgaagaggagaagggctttaagaaggatccggaatccatggatgcaaaggaactggaaaagcttgcaaaggagcttacaaagaagatgcaccaggctgcagcggagctgaatttcgaggaggcagcaaagctgcgtgaccggatggttcagattaagaaaatgcttcaggatatggacgattgagggctggcttgaccgcccgacaaaaatgttgcctggcgggggagatggtattgacagtgattctcaataagagtaaaatctcaatggacgcatttaaggcaagagccttggagcgccgccggtaggattggctgcgtccggaggagattattatgaagctgtatgaaggagaaatcggaaaaacctacattgtttacagtgtgatggtaaaggatgccatcaccaggcgtttggaggctctgggggtcaatgagctgacgcctgttaccctgatgaataagaaggggagcggtactgtgatcattaaggtcagaggtacccgccttgcccttggaagaaggatatcggagggaatcgaaatcagggaggctgtggaacatgcgtgaggaaaacaggatgattcatgtcgggtttgtgggaaaccccaactgcggaaaaacgaccttattcaatgcttttacaggggcaaagcttaaggtggctaactggccgggcgttaccgtggagagagtggaaggagagaccagctacaagggccgtcctatccggatggttgatacgcctgggatttatagcctgacatgctatactctggaagaaaaggtaacaaggaaatgcctggaaaatggggaagtggatgtgatcatcaacgtggtggacgcctcatccctggaacggaatctgtatttgacccttcagcttctggaactaaaaaagccggtcattctggcccttaacatgatggacattgttgaagacaggggaatggaaattgatttacaccgtcttcctgagatgcttggatctatcccggtggttcctgtttcagcaagaaaacggaccggacttgatgtgctgcttcatgcggtggttcaccattatgaagaagggcctcaaggcgtggtggtgaattatacgcctaaaattgaaaataggatttccaagattgaaaccgtactaaaagcccattacgggaacatggataatctaaggtggcatgccatcaaatttctggagtatgatgaggaggtctggaatgaccatcccttggatttaagcaatattgttgaccataattatgagaaggagatcataaaccagaaatacgactatatagaaggaatcatcaaggaatgtctggtgaacaaggaagagaaagccgcgtttacggataaaattgatgaatatctgacccatccctttttgggcgtgccttttttcttgggcattatggccctggtattctttctgacttttactgtcggtgactttttaaaggggtattttgaaactgcgctgggcttattttccaccagcatgcagcagtttatggaaagcatccatgcagctgactggatcacttcccttgtggtggacggaatcgtggccggagtaggaggaattctcacgtttctgcctaatatctttatcctgttccttgcgctggcttttctggaagacagcggatatatggccagggtcgcttatgtcatgaatgagatcatgggtcgcgtgggactttccgggaaagcctttcttcccatgcttcttgggtttggctgtacagttcctgctgttatggccgccagatcccttcccagtgaaaaggacaggaaaagaactattttaattaccccctttatgtcctgctctgccagactccccatttacgtactgttttcccagatgtttttcccggaacatgccttgatcgtggcatattccctgtatctcatcggattgatggtagcaattgccatcgcttatgtgacccactggagccataaggcggaggaagaggatacgcttctcatagagcttcccgaatataagacgccaaacgggaggacggtaggtatttatgtatgggacaaagtaaaggattatttaggaaaggcgggaaccaccattttccttgccaccattgtgctttggtttgtcttaaacagcgggtcgtcaggatttgtcactgatgtttcacaaagctttgcagctgccatcggcagggttctgattcccgtgctgcgccctgcgggccttggagactggaggatcgctgtggctttgatttccgggctttctgcaaaggaagtggtggtttccagcttttcagtcctgtttggaatcaacaatataaattctgcggcaggaatgggagagctgtccggcattcttggaggcattggttttggcggtgtgaatgcttatgccctgatgattttctgtctcctgtattctccgtgtattgcggctgtggcaacgattaaaaaggaaaccggttccataagatggactcttggcatggtacttttccagctggcagtggcctgggcagcttctgtacttgtatttcagcttggtagtctgattttttaaacttcatattatgggaagtaaaaagcactttccataatcggatgaacgggctgaaaacagcccttttatcctcacttgccttgcaagttcggataagttataataatagaggaataagcctatgaatgataagctgcttgtggagactgcagttctggcaggagagatcatgctggtgagcggtgcggagatttaccgggtggagaataccattgaccacattttacgaaaagcgggcagagaaactgcggaagccattgttttttccacggggatctttgcatcccttaatgatccctccattgaggccataaccgtagccagaagggttacgggaagatccaccaacttaaacagggtgtatctggtcaatgatgtttccagaagcctgtgtgaagaccgcatgacggtggaggaggcttatggaagactgaaagaaatacggaatgcaattcagtacggcagaagattaaaggatattggaatcatgggagtggcagtattttttaccctgcttttaggcgggagagcaaaagactgtctggctgctgctgtgaccggaattgccctggcagcggcgatggaggtatccgtaaggaccagactcaatgatttctgcgccaatggagtctgcgcatttataattgccgtttccaccctttttatggaacggtggcttatgcccggaatcaaaagtgacattatcatgatcggtgcaatcatgcctctccttcccggtgttatatttacaacggcgatccgggataccttaaacggggattatgcctcaggaacagccaggatcatggaagccgtagtgatcgctcttgcggtagccgcaggcgtgggagcggggatgggattatttcagtggctgacaggaggtgggctttcttgatagtacagacaattggggccttcctggctgtgatcagtttttctctgatcctggagcttccaaggaagcatgtggctttggcgggaggaatcggcgcggccggctggcttgtctatctgttggtggaagccgcagctggatctgtcatagccgcggcttttttatccagtatgctggtggccttatccagccacatttttgcacggatttttaaggcgccggttacggtgtttctggtggcgggcatcctgccgtcggttccgggaacgtccatttaccggagcgtgttttatgtgatcagcaataacccggagctttccagccactatctggtggagacgcttcaggtttcgggtgccatagcaatggctatttttatcatggattctttgttccgattggggcagaagaggtgaaggcaatggtcagcttatcgctgcttttggaatagaaatagatgtgattggacaggcggtcttcttccgggacttcttcctgattaatggagagaacggtttccgccaattcatcgatggagatatctttgttgtatggaatgatgaggacttcgtgaatgctggagggcagtatgatcaaatcgctgccgctgcatgaggcgaagtcttttaatatgccctcataaagaaggcatccggctccgttgataccggaagaattggacagcacgtacataggaggagacaaaggagcggtatcaaaaaattcttccaggtcttcttcgtttatatcgttttcagacgatcttgttgcaatgtcttttatggcttcgggaagagagcggattcgggcagggaacagacggggagtgttggatttggcagctgagtatatttcttctgcagaacggttccacgctttttgatgacggttgcagataagagcggtaaggagactgtcttcatcgttttgaaatgacaggtagaatatgatggaaagatccagctccggataggagatatgaggtacttcctttagaagctcccggttggccggttcgttgataaggcggaagatgattttctccatgatctgatctgacgataggaattcttcaatgggaaggtcacccggcagtggactgctttggtaaagggacatgatgtcatcaaggatggcatgaaaaggcctgccgttttggtaggattcatagaaatgatttaaatagatagtgggggcggcccgttcctccgctttcccgatacagagcccatggaggatcagtccgttgttcttggtaatgggctgaagcacaagggtgaattcaggtccaagccgttctttcagagaatgtttgacagtttccagaaatgtttcgtataccatatgtatacctccttagatttgtttatgtaaactgcttgatgcagaattacaacaagaatagaattggtggtggaatggatgattgagtgttgaaatatgagaattgccggattttaggctctttcattataatggagatggtaataaaaaacaatattattttgggaagtttttcagaagcagagaatcagggatatttcgtttatctttaccgcatattttttgtgtcaaaccgggataaacaatgatagagaagcgtttaaagtacgaaagcgtttcaggccatgtgtgggtatattaaaaaaggcttgcagaacaagggctgcctaatccagccgttgcgtaagagtataataatacaaagaattatttataacataatgttatgaacaggtaagattagcatataattaattaataagatcattagagggaagttatggtcatacatgttgttcaacccggtgaaacaatattttcaatagcggagtattataaaatccctgttaacagattaatattggaaaacggaattataaaccctgacaatttagctgttggccaaactattgtgattgttcagccggaaacactctacaccgtccagactggcgatactttggagagtattgcagagcagcacggtgtttcaccaatggaattattaagaaataatccatatctttccgatagagaattactgtacattggtgaaaccatagtcataagttatcaaacaaataaaacaagaacaattgcaaccagcggttatatcttttcttatatagatgaatctgttttaaaaaaaacacttccttttttaacatatctgaccatattcaattatagggctacaactgaaggagaaattgtcatccttgatgatgatacggaacttattcagctggctaaaacttatggtgtggcacccatgatgtttgtttccgctatttccgaagagggaatcgtcagccgtgaagtgacctatcatattttaaatgacccttccttgcaggatcgcctgattaataatgctcttcaaatactgaaaacgaaaggtttttatggtatcaacgtatatatcgaaaacatgaccaatgacaacatagatggctttgcagaatatttgaaaaaagcctctgagatatttcgctcagaaggttacagaatagtgattaccataacaccggttacgaatattgataccccgaacattagctttgaaaggatagactattcaaaattatctggatttgtagatggaatcatattctcttcttatgattgggcaagatcatacagttatccaagctcaatttttccggttaatatcttaagagaatggttagattatgcggtcagtattattcctgctgaaaaaatatttctgggagtcaccactctggggtatgattggacacttccctatgttcccggcgccacagaagctgttgcaataaactttaacagtgcggtccagattgctgcagtaaacgatataccaatacaatttaatgaagctgcacagtcaccctacttctattatgtggatagtgatgaggttatgcatgtagtatggtttaaagatgccagaagttttgatgcaagagctgggctggtagaagaatatggcctccagggcttatctctttggaccgttatgagatttgatacccaaatgtggcttattattaatgctcaatattacatagaaaagatctaaatacacttttcattaacattttaggaaccatgaatgatcaaactgctgcgctgtaatgagtattttataattgtatagcaatgataagtttccgtcagaaagttatccatgactcagtacttcatcttatctccttaaatagacaaatacatttagtttgatttatatagagttaaatattatgatactttatgccgcaacgtacgctgagccaaagaatatgcagcaatcaggtaattggcaatgatgtttttatttacagtcataataaaaaacgtatggcttaattaagggaattgtcctcgttattatcatacacttacattgtacaaattacatttgaaattcaagtaaaaaattcattgagtcggctgttgccggctctttttgtatacagaatttaagaatgtggagaacttacaatagaaaatttgtattaagcaacgccgacatgcgggaaaatttcggatttggtcgagacaatttgaaaaaattttagaaaaggaattttgacaatagtacgggagataaggattatctgattttgaaaaaagagcttaacacatggttcaggaaaatgctggaaaggattcagaatgatgagcgatatgaacagaaaagcctaaaatgcggatcagcggatttgcttgtgcaataaaaaataaatgaatatgagaataaataatcaatatgataaggaatgattagatctatcggattatgaaaatctggtggcttttgcgttggtaaaatagtataatgaaggcatagcaaaatgagtaaaagagttgaatatacggcgatcggtaaggttaagtctgccttgcagtgtgtgaaagaaattattgggaaactgaaaaggaatataactatgccattagatattaaaacatattgggatattaaaggagagccagttgccactacaccaacaacctgggaagtggagggaaagtatatcttaaagctggtgaaagcagatgacaatgtacatagtaatataaggctttccgcagcattacgtgcagatggggttccggtaccacatattctgccgacaaaggatggcagggattatgtggcgacacaagagggctgttatctgttgatggagaagctggaaggcagtcatgtaagagaggtatttcagcaagactatgcagccattgcttaccaaaccggcattattattgcaaaaatccactgtgcacttatgacaataacccatatacagattgataggcctccttttgatgaggagctgcgaggctggatcagcaatggactttctgccggcaatttgctgacacaagaagagtggtctaagccaatagaagaactttgcagaatttaccccctgctgccaaagcagcagattcaccgggatctgcattatggcaatttgctgtttgaaggcacaacgttgaccggtgtactggattttgacctgggtaaacaggatgcccgcttgtttgacatagcttatttcctgctggggcagttatcaggtcagaaagaccttgcggaaataaaggataagtggcttacatttgtcagccattttcttagcggatatgaaagtattaatgtgttagaagaaaatgagaaaaaagcattgcctttcatgatgcagtgcattgagcttatgtttatggtcttttggcagcggcaagcaaatcaggaagcagctgaggaaacgattaatattttaaaatttgtaaaacagatgttataagcagggctgatggaaagagatggcaatagtaagcacatgttaggagtttaagaatccaataaagcaatagctgcagctgccaccggttccatcaaaccattcgctgcttttaatgaaatatgtaatactggtattgcatatggcaggacttactattgacgtggaccgttggccggtatagaaataaggccgtatagaaaataactgtttttaggagaaataatggaagagtatatgaatgagccagtgaattgtgtatttaccgatgaggatattagaaaggagtatgagcgattcaatgacattaagagagtggcagcagtgttttgcctggataataaaacagtgaagcagatattgaagaaagaaggggtattgtgagtgttggagacagaataatttataaatacaatgaactgagtaaagattatatgaagacaggaatcattgtggaaaggtatggagatgaatataatctctgtaaagtattatttgatgatgggacaagccattaccatttgataaagtatttgagcagatttgaatagacggaactccatagttacttatcaaaagatcaagggatacgcatggattttacttcctgggaatataatggctgtttttatgggaagctgaattgtgaggcagaacaaagtttgtcagcatgagcagaaaaaaaaccaggtttccaattgttgaatcggttatggtttattttttatgcttcgttcccctgaaagagcgaaggtgaaaagtgaagcaaaacataatgctggagtttttttgatttttaatgaaattacaagaataaataatatgatttaccagggaggaagagtatagtggaattttattttaaatcaaaaggagcaaaaacacatctttaccgggaaaatggatttatcgatgaagatttgggagaattgacggaaacatttactggaaaactgataacaaagaattttttcggcgaaaactttgagttagaagatatatccggattcttttcaaagggtaataggtattccatcaagagttctaaaggacttaaaggcgttattgagaaaaagggctttggggatagatacattttgaaataacaaaatttgatcaaggaataaatactaattttaaagtggtaaacagggcattggagaatccagtgcctttatttagttcttatagctgctattgattaaaacaaaatactggtgattgagagtctgtaaaatggagtgatcacgatcttgaagttgaattatctgagcagcctgccttaatagctgtgatgcagaacaggagcttgatgattaagtgaacaagagcttaagcgtataattaaggaataaaatgaggacagggcaaaatatactgtaaaagcggaaaccacatcttcccggaacgattcggaattttggatgagaacagtgcaatcatgattaccggcttatggaatgagaattggtgaagctttggaatgggaggctcagcaaagggctgataaatacgagaaaatccttataaaataaggctttttagagatgcaaaaacagacaaaaaaagagtgcatctgataggaatcgaacctacgcacgcggctccggaggccactgctctatccactgagctacagatgcatcttttatattctactatagattcttttaaagcgcaatagtatttgttgatttttatcggtttttttgttagaatggaaaggagattgattctccaggaggtcaagcccatatgaaagatttaatcgaaaaatggaagaagagttcaaaggaagagaccagaaggcttctgaaaattctggccattcccttggcggtaatcatattgatttttgccgttgttattttggatgagcctgaacaggcaggaaatgattcggatcatgtatcagctgaggcgaccgaaagcacggcggcggagcctgaagagaaggagatcacgctgcaggaagaaaccataccggcaattcatgatctcatggaagcttatttcaaagccagaaagacctgcgatttagaggcactttcaacggtatatggcaataccagttctgaagagatcctaaatgaacagagcgtcagaatggaagaagaagtgaaattttaccagagctttgaaaacctggtgtgctatacggcgcccggcgtggacgacggtgattacgtggtttatgccaggtttgatatcaaattccgtcaggcggaaaccctggcgcccagcatggttgtatgctatgcaaaaacagcagcagatggaagctgttatctggtggcggatatcagcccggaacagtctgaatttatgaagaaggcaaaccagtctgaggccgtgcaagggcaagcaaaagaggtaaatgacggtcttgagaaagccttaaaatctgacgaaaatcttttggcagtctaccacactctcatggacgagaaggaagagccggaggaggagacaacggatttaagcaccagcccatcaaacaatacgtaaaacagatgcttctctgcgtagcaccctgcagaggagcatttttggcaaaggagagttactttatgaacgttagggacttttattttgatctgcccgaagagctgatcgcccaggacccccttgaggaccgttccgcttccaggcttctggttttggataaacatacaggagagatcagacataagcattttcgggacatcctttcctatttgcggaagggagactgtctggtcattaatgataccaaggtcattcctgccaggctgtttggagtgaaagagggaacagaggcaaaaatagagattcttctattaaagagaagagaagatgatatttgggagacccttgtaaagcctgggaaaaaggcaaaagtggggacggtgatctcctttggagagggcctgttaaagggaactgtaattgatgtggtagaagaagggaaccggctcatccagttttcctatgaagggatctttgaagagatactggaccgtttggggcaaatgcctttgccgccttatatcactcatcagcttaaggacaagaaccgttatcagacggtttatgcaaagcatgagggatcggcggccgctcctacagccggactgcatttcacaaaagaactgttaaaggacattgaggagttgggagtatccatcgctcatgtgactcttcatgtagggcttgggactttccgcccggtgaaggtggatgagatcgaagctcatcacatgcattctgaattctatatcgtggaggaggaagaggcaaaaaaggtcaatgatgcgaagaggaatgggggccgcgtcgtctgcgtgggaaccaccagctgccgtacggtagaatctgcctccacggaagaggggatcttaaaggcaggaagcggctggacggagatattcatttatccagggtaccgttttaaaaccctggattgcctgatcaccaatttccacttgcctgagtccacgcttgtgatgctggtatctgcacttgcaggacgggatcatgtgctcttcgcatataaagaggcgatcaaagagcgttaccgtttctttagttttggagatgccatgtttcttacggatcttcatgatgaaaaagagtcctgagaatgaaatgcaaatgcattttaactgaatcaagtagcgaagcggattgcgaatatccgcttgactataaagaagaatggggaattctgcagttaaaaaaagaggtaggggtacatgctcatggaagagaagaaaaacatggtcggaggaatatccaggaagaccctggaacgtcttccgatgtatcatcattatctggaacggaaatgccgggaaggaacagagaccatatcggcgccggccattgcattggatcttcggctaaatgaagtccaggtgcgcaaggatctggcaatggtggccaaaacagccggaaaacctaaaatgggttatctggtaaaggacttgatcagggacatggaggagtttttagggtttcataataccaaccaggcggccctggtgggtgtgggttccctggggaaggccctgctgtcgtacaaaggatttgagcagtacggtgtggagattgtcctggcttttgattccgatggaagaaaagtgaatacaaagataggcggaaagccggtttttcccatagaaaagctggaaaacctctgtcagaggatgaatattcatatcggcatcatcacggttcccgcggaatatgcccaggaggtatgcaaccgcctggtggccggcggagtgagggctatatggaatttcgctcccacccatctggccgtaccgggtcatgtactggtacagaatgagaacatggccgtgtcactggcagccctgtccaaatatctttatgaggcggacaaggaaggcgggcagttggcaaaggaggaagatgattgaatactgtattgttgcaatatgcccttgaagtggaaaagacaggttccattacccaggcagctgccaacctttatatggaccagcccaatttaagcaaggctatcaaaactctggaagaaagccttggtgcgccgatttttaaacggacttccaagggcgtggttcccacggcaagaggaaggatttttctggagcatgccagagatgtcctggttcagatcgagagaatggagcacttatacaagccgaatgaggtaaaaggggtggaattctctctttccatgcccagggcaagctatttaagccttgcattctcccggttcgtccgaaatttagaccgggaggaagggatgaatatatggctgcgggagacaaattccaccgatactttaaaggatgtggagaccggtgaatacaatctgggtatcattcggtatcagtcctctttggaaggacagtatgcccaggccgctgccgcaaagggccttttgtgggagccggttttccaatactccttaaggcttctcatgtccgcagatcatcccctggcaggaaaaaaggaaattaccacagaggatttgatcccctatatagaaattacccatggtgacggaaccattggccgccgtgagagctgggaaaagaagggaagacttccggagtctgcaaaacgtgtttacgtatttgagcggggaagccagtttaatctgttattggaggatccccacacgtatatgtgggtttctccaatgccggaggagatccttacaaggtatcatctggtggaacgtcagtgcaggaaaagggccggaacatttcgggataccctgatctacagaaagggatattcgttcacagcctgggataaagcatttttaaaagaactggaagcagtgaaacgtattttttgaaataagagtgttaaatatatatcagtatttatatactgatatatatttttttacctttgtatttcctttctgtttgagctacaatactgcatagatacaactgaactggaaattcataaggaggaatatacgatggctagatttacattaccgagagacttatatcacggaaagggcgccttagaagagcttaagaatataaaaggcaaaaaggcggtcgtggtggtcggcggcggttccatgaaacgttttggttttcttgacagggtggaagcatgcttaaaggaagccggaatggaagtaaagctgtttgaaggcgtagagccggatcccagtgtggatacggtgatgaagggcgctgaaatgatgcgggagtttgaaccggattggatcgttgccatcggcggaggctctcccattgacgctgcaaaggcaatgtgggcattttatgagtatccggagacttcatttgaggacttatgcattccctttaatttcccgactttaagaacaaaagcaagattctgcgcgatcccgtctacctccggtactgctaccgaagtaacggcattcagcgtaattactgattataaaagaggaatcaaatatccgctggcagatttcaacatcacaccggatattgcaatcgttgatccggatctggccgagaccatgcctcagaagctgactgcccatacgggtatggatgccatgactcatgcggtggaagcatacgtatccactcttcattgtgattacaccgatcctctggcgcttcatgcaatcaagatgatacataatgacttgatcgattcctacaacggggacaaggaagcccgcgcccgtatgcataatgcccagtgtctggctggtatggcattttccaatgctcttttaggcattgttcactccatggctcataagacaggggccgcttattccggaggtcatattgtccatggctgtgcaaacgccatgtacttacccaaggtaatcaaatttaattccaaggttcctgaggccacaaagcgctatgcagagattgcccgcttcatgggtcttaagggagggaatgaagaagaactggtcgatgcattgattgaagagatccgttacatgaacaaaaagctggatattcctacctgcattaaggattatgaaggcggaatcattgacgaggcagagttcaatgaaaaattagtgtcagtagctgagctggcagtaggtgatgcatgcaccggctccaatccaaggaccattacgcccgcggagatggagaaactgctgacctgttgttactatgataaagaggtagatttttaaataatctccagttaatgaatgcaatgtgtgcggcaggcgcagaaccttttggttttgcgcctgttgtgcgtgaaaaggaatttgacagtaaagttcatctgtgatatggtaatcgggaaaaatgaagagaaagcaagggatatcaggatgaaacaggcgattttagtcgtgagttttgggacaagctatcatgaaagcagaaaaaagaccatagaggccattgagcgggatataatggaagagtttaaagattatgaggtgcgccgggcatttaccagccggatcatcattgaaatattaaaaaagcgggacaacctttacatagacagcgtggaggaggccctggaaaagctggcgatggaaggattccagcaggtgatcgtccagcctactttggtcatgggaggagaagaaaacgatgcaatgctggccgctgtaaaacagtatgaggatcggtttttccggatcgtgcggggaaagccgctgctttctgaagaaaaggactatgaaaggttatgcagtgtgctgacagaggatacaaaggaatatgacacggaaggaacggagatcatattcatggggcacggtacggagcatgaggccaatgagtgttattcccgcctggcagaggttttcaggcagaatggatatgacagatatcatgtggggactgtggaggcggaaccggattttgaagcaatagagaaagaagtgaagcaaacggattccagccggatggtgcttcagcctcttatgatcgtttccggcgatcatgccaacaatgacatggcaggagaggatgaagatacctggaaaagccagctggagtctgatggctaccatgtggtctgccggttaaagggcatgggtgagctggagggagtccgccggatatttctggatcatgcccgggaagccggagagaagctggaggatatgaaatgaaaaaaggaagggcggcaattttgatcacaggtatggcggcgcttttgcttgcaggctgtgaaagacgggtggagccggtgagccaatccggctttttgctgaacacttttgtgacggtgaccctttatgataaagaggatcctgaaatcctttcgggttgtctggatttgtgccggtcttatgaaaatattttaagcaaaaccattgagagcagtgaagtttataagctgaatcacaggccggccggtgaaacggccgtgaccgtatcaccggatgtggcggctcttatttccaagagcctttattattcccaggtctcggacggggcctttgatattactgtagagccattgtcctccttgtggaactttacgtccgaaaatccaacggttccgcctgaggaaaagattgaagaggccaggaaaaaggtggattaccggaatttaaagcttgatggaaatacggtgacctttttatccccggacacttctcttgattttggggccattgccaagggatatattgcggaccggatgaaggattatctgctggaacagggagtgaaaagtgctgtgatcaacctggggggaaatgtactctgtgtggggcagaagcctgacggcaagccgtttaaaataggccttcaaaaaccttatgcagacaggaatgagaccatagagaccttgaatatcaaggatatgtcggtggtttcctcgggggtgtatgagcggcattttgaaaaggatggcgtaaactaccatcatattttaaaccccagagatggttatccatatgaaaacgggcttgtgtccgttaccattttgtcaacgcagtccgcggacggagacgctttatccaccacctgtttttctcttggacttaagaagggaatggagcttttggattctacagacagggtgtacggcgtgtttattacagaggatggggaggtctattattcccagggtgccagggagtttctggcagcagagccttagaatccctttacaatttcctctccctataatacaatagaggaaatgtaattttgcaggagaaagaggaaacaccctccgggtatacctttatgtccaaagggcatggacaggaaagaggaaatttatgatcagaaagatctgggacaaggtcatgagccgggaagtcatttcctatctgatatttggagtgctgacgacgctggtaaactgggttgtctattggttcatggtaaggacaggcatcgactaccgggctgcaacagcggccgcgtgggtggtttccgtcctgtttgcctttattgtaaataaaatctttgtttttcaaagctatgacctgcatctgagggttgtcaaaaaggagatcgtatcgtttaccgcatgcagagcagcgtcaggcgtcatggaaatagttctaatggtgataatggtttcctggctcaatatggatgaatacgtaagcaaaatactggtatccgtggtagtagtgattgcaaattatgtgttcagtaaggttttcatattccggaagagagaggaaaaacccctgtaaagagaggtaaatggaatggaacacgatgacgagattgaaaagatatcgaaagagctagaggatatgctgcaaatgacatcaggtgaaaaagaaaatacaacaggggaaaaggctttaaagacaggaaacaaagaggaaaaagaggcttacggtccccagggaaaaaatacaaaacaggaatttgatccggcttccgcgcccagaatccgtcttgatattccggttgacggaatggaggagctgtatgatgacgggacggattatgacagggatttggagccgttgatggaatctgtgccagatccggatctcatggaatttagtgaagaaccggaagaagacgaatatgaagatggattagagatacggcaggaagaagactttaaacaacgggcatggggaaagaccgaagaaaaagccttcagcctggtgaagccttctgacggccttttggcggcattttttgtgccaatagtgatcatggtcatcatatttgcccagcgggggatttttccctttggcgaggaaagctttctgcggaccgatatgtatcatcagtatgcaccgtttttctctgagttccgttataagctgacccacggaggaagccttctgtacagctgggatgtgggtatgggtgtgaattttgcggccctttatgcctattatctggcaagccctttaaactggctggtgattctttgtccgaagaattatgtcatagagtttatgacctatatgatcgtatttaagatcgggttaagcggtctttccttttcctggtatttacgcaggcacaatcataccagagattttggaatcgccttttttggcatcttttatgccctgtccggatatatggcggcttacagctggaatatcatgtggctggactgtatccttcttttccctctcatcatgctggggcttgagaagctggtaaaggaaaagaagtgtttcctgtattgcataacactgggattatcaattttatctaattattacatatctattatgatatgtatttttatggtattttatttcgttgctcttcttatattagaaggctggaaatcctggaaggaactcctgatcaatgcagggctctttgccttgtattccttgctggcaggaggcctttcggcagcagttctgcttccggaagtttatgccctgcagtccactgcttcgggagattttaattttccccagaccataagctcctacttctccatatttgacatgattgccagacatcttcctgcggtggagccggaaatcgggctggatcattggcctaacatctactgcggtgtagctgttctcatgtttttccttctctacctgggctgcaggcagatcaggcagagggaaaagatcgttatgtgctccatgctgctgtttttctttgccagcttttctgtcaatgttctgaattttatctggcatggatttcattatccaaacagcctgccgtgcagacagtccttcatttatgtttttctcatgctgctggtgtgctatgaggcctatattcacttacatgagatcccttggaagcatgttgtaacagccttttttgcttccgtgatttttgttctcctggcccagaagctcataacggatgaggcttatcatttttccgtattttatgtggccattttgttccttgccatttatgcgggacttgtgggcctgtaccagaagggagtcagccggaatatgctggtgttgttagcccttggtgtggtttctctggaagctgccgtgaatactacggtcaccagcgtgacgaccaccagccgtaccaattatgttaaggataatgaggcctcttcagagctggcaggaagtctgatgcccaacacctccttttaccggatcgaaaaggtcacgcgaaaaaccaagaatgacggagcctggctgaatttccctacggtctccctgttttcgtccacagccaatgcggaccttacggcgttctttaaaaagctgggctgcgaaagctccaccaacgcttacagcattacaggaagcacgcctctggtggatgccctttttgcggtcaaatatgccctgtactccgaagaaacagaggacgacggtgtatcggtgccggtctcctcaaaggatgagatgtatcttaaggaaaatacctatgccttatctctgggctttatggttccctatgaccttgagaacaattggcagctggaccgtacaaacccggctgaggttcagaatgatctttccgtggtgctgggagccagcccggtgctttctgaaattccaagtgaaatctcgggaaccagctttacctttacaccggaggcggatggagactattatgtatacgtcagcaataaaaaggtggaaaaggtaaatgctcagttaggagagcggaccaaaagctttgacaatataagccggggatatatgctggaactgggatatttaaaagccggggaagagattaccttgaaaaacgatgacaatgatcaggacctggtagctgctgcctaccgtttcctgccagagggactggaatcggtatacaatattttgaacaagaattccatgaagctcacaaagtggacggatacccagatacaggggactgttgaagccgaaaaggcagggctgctgtttttaagtattccctatgataaaggctggaccgttaaggttgacgggaaagcagtggagccttataagatatttgatacgtttttaagtgtgcatatgactgcaggaacccatgatatttctttggaatatatgcctcagggattgaaaacaggcggtatcattacggcaggaagtgtggttattctgctggcccttgcaggtatatccgcagttaaaaggaaaaagcgcaggcccatgcgggttcattctacaagttaaatacttcgcaggaagcacacgggtatttgactccgtgggcagccgccaaagtcaggcaagcctggcctcggcccgccgccttcgccagaataaaggaaagaggagattttaattatgaaactatggggcggacgcttcacaaaagaaaccaatcagctggttcacaactttaatgcatccatatcatttgaccaaaaattctatcatcaggatattgaaggcagcatcgctcatgtgaggatgctggcaaaacagggaattctcacggcagaagacagggataagatcgtaaacggtcttgtggagatccgggaggatttggaaaagggagatctggtgataactgcggagcatgaagatatccattcctttgtggaagcagtattaacagaacggatcggggaggccggaaagcgccttcataccggacggagccgcaatgaccaggtggctcttgatatgaagctgtataccagagatgagatcgacgagctttcttccctggtgaaaggacttcttaaggagcttttaaagctcatggaggaaaatctggacacttatatgcctggattcacccatttgcagaaagcccagccaatcaccctggcccaccacatcggcgcttattatgaaatgtttgacagggaccgttcccgtctttctgacatcaaaaaaaggatgaattactgtcctcttggctccggcgctttggcaggaaccacctatcccctggacagggaatatacggcggagcttctgggatttgacggtccaacccttaacagtatggattccgtggccgacagggattacttgatcgagcttttaagtgctttgtcaaccattgccatgcatttaagcagattctgcgaagaaatcatcatctggaataccaacgaataccgctttgtggaaatcgatgattcctacagcaccggaagcagcattatgcctcagaaaaagaatccggacattgcggagctgatcaggggcaaggccggcagggtctatggagcgctggtttccattctgacaaccatgaaggggatcccccttgcctataataaggacatgcaggaggataaggagctgacttttgatgccattgatacggtaaagggatgccttgccctgtttacgggaatgatttccaccatggccttccgaaaggatgtgatggaggccagtgccaaaaacggctttaccaatgcaacggatgccgccgattatctggtaaatcatggggtggccttccgggatgcccatggaattgttgggcagctggtgctcttctgcattgaaaaggggatcgccctggatgatatgagcctggaagaatatcaggccatcagtcctgtgtttgaggaagatatatatgaggccatcagcttaaaaacctgtgtggaaaaaagaatgaccatcggagcacctggtcaggaagcaatgaaaaaggttataaagatttataagaaaagacttgaagaataagatgtgaaagagcagcagaagaggagcatcgctcatggcctgaggacggtcatgggtggtgttcttttttcatattagtggaagctgcattcttatatattaaaatatttctcaatagagaattgctctgcctagccaactaaaacacatgtgcattaattttttgtaaagatttgggcgaattatgttaagaagatgttaaaaaaatactaggattcttaaaaatttacggtagtacttcctttttttccatgttaagattgaaaaaaaggagggttcataacatgaaaaaaagagcaattagtgttttaatgttggctgcactgacagccgcatctctttcggcttgcggcggttccaataaaaatgcagccacaactgaagcggccacaacggcagcttctggggaaactacaaaaggggaagagtccaaggatgctgcttctgcagatcctgaagtaacattggtgtatgccgaggttaatcccctggataccattgtaggaaagaccgatcaggcgtttaaggataaggtagaggaattatctggtggatcgattaagatagacttgcaagccagtggtgttttaggagcagagaatgacgttcttgataccatgcttggcggcggcggaaccattgacatgtccagaatctccgcatttgctttgaccagctacggtgcaaccaaatccaaactgctgtctattccttatacgtttgcaggaagagatcattactggaaattcgtaaacagtgatctggctcccgaattcttaatggagccccatgatcttggattaggagtaagaggtctgttctatggagaggaaggcttccgtcatttcttctcaaaggatccggtaagcagcatggaagatttaaagggaaagaagatccgtgtttccagtgacccggttatgacaggtatggtaagtgctttgggtgccaaccccacagtagtcagcatgaacgagctttattctgctcttcagaccggtgttgttgatattgcagagcagcccatcgcaaactataaaggcaatgcattccaggaggttgctcctaatctgattctggatggacatactcttggtgccattcaggttatcattgctgatgaatcctgggacaagctgaccgggaaccagcagaaagctatgatcgaggcggctcagtatgcatctgactttaataaaaagctttcccaggatgaagagaataaagtattggatgagctgaaagctgcaggtgtcaatgtggtagacgttaccgacatcacaccatggcaggaggcctgcaaggatgtaattactgaaaatacaaaggaaaacgcagagctatatcagcagatccttgatatgaaataatcagtttcaaaagaagggcacagaagccttagccttctgtgccctgatcattagaaaggggatctttatgccagaaatatttaaaaagattgacaaaataaagcctgcttatgacatgacttataaagttgttctgcttatatgtaagctgcttttgatcggcgatgttctgatcaccagtatgtcggttgcgggccggtacatttcctttattcccgatcctgcctggagtgaggaggtcgttctgacctgtatggcttatatggcggttctttccgcagcccttgcgatcaggaatggttctcatatccgtatgactgctttggattcttatctgccgaagaacctgctaaaagccctggatatcctggctgatgtagcggtctttgctttggcggtcatcatgcttactgtaggctggaagtatgctgccggtataggagccaagggattttataccagcatgccgtggctgtccaggttctggatgtatttcccggttccgctggcaggtgctgctatgatcatttttgaatcagaggccttatataatcacataaaaagtatctatgtaaaggagggaaatctgtaatgagcggcaatatagtaattcttattttattgggtagcttctttctgatggtactcctgcgttttccaattgcttatgcagtagctctttctgcagtgttctgtctgctttcccagggaaaatccttcacgatcatctgtcagcagatggtgaaaggaatcagttccttcagtctcatggcggtaccgttctttattaccatgggagttttaatgggatccggcggcatttccgagaaactcattgctttggccaatgcctgtgtgggatggatgcggggcggaatggccatggttaatatcgttgcttcctatttctttggaggaatttccggttccgccgctgctgatacggcttccttaggctccattctcatccctatgatggtggatcagggctatgatgatgacttttcaacagctgtgaccattacctcctcctgtgagggacttctggtacctcccagccacaacatggtcatctatgcgactacggcaggcggaatctccgttggaagcctgttccttgcaggttatattcccggagccattcttgcactgtctctcatgataggttcttatattatctctgtaaagagaaactatccaaagggagataaattcagtatcaagaatcttgtgaaacagcttggagtatccttctgggccctggcagccgtgctgatcgttgtgttcggtgtggtaggaggcgtgtttacggcaacggaatctgctgctattgcagttatctatagcctgatcgtcagtgtgttcatttacaaaggtctggactggaaaggcgtatggaaggttatggaggattgtgtcaacacccttgccattgttctaatcctgattgccacctccaatgtatttggatattgcctgaccacactccatgttccggatctggcggcaagtgccattaccggaataacagacaatccgattctgctggcattgcttttgaatctgatcctcctgatattgggatgtatcatggatatgtcacccatcatccttattgcaacgcctattttgcttcctattgcaacctccattggcattgatccggtccagttcggtattatcgtggtgttgaactgcggcatcggtcttctgactcctccggtaggggccgtgttgtttatcggttctgcggtggccaagctcccaatggaaaaagttgttaaggcgacacttcccttttatgtttgtatgattatcacgctcttgctgatcacctttgttccggccatcagcttagggctgccttccctgttggtaaaatgatgatcctgcagcgccccggcgggcaatggtaacatgaacccataagaaggctatggaatcaggcatttcttttattaatgcctgattctattttttcataatgaaatacacttggggtatactttaaccgaatcaagcagcaaagcggattgcggacatccgcttgactcaggaaaggaagaaagaaatgaaataccaatatacttacaggaatacggcgtcagatatctggcagttatccatgtactatatttatggttccatggttggtgtgtgcaatatcatttttacagcggcagtttttgctcttggagtggccagatggaattcatccggcctttttttcaagatctgtgtaatcctgggctgctgcctgtttccgttgattcagcctgttttagcttattggaaggcgaggaaccaggctgctgccatcagacaggataccttggtgcgctttgacgataaggggatttatgtgaagctgggagagaactgttcggaaaccaggtgggaaaaaatcaggagagttgcccggaaacccggcatgatcctgatcttttccgattccactcatggttttgtgttgacaaaccgggttttaaaagaagaaaaagatgaattttacgcttatgttgtctcaaagatcagaacaaacggcaaggggacggcttcatgatgaaggggaatccgagccaaaaatctgcttgcgaagacggcaccctgtaggggtggcggcaaggccgccttcagaggtttcttttaaggaggaggacatcatgtttcccacctgtttcatggccaggatcacctcgtctgctgggatggcacttgtgatcccggcacaggcaagctctgaggcggtaaaggcattggcaacacccatggcgttgcgcttaatgcagggaacctccaccaggcctgccaccggatcacacaccaggcccatggtatttttaagggcaatggcgcagctgtcagagaccatctggggagtgccgccgaagatttccgtaagggcagccgccgccatggcggatgcagagcctacctctgcctgacagccgccttctgcaccggcaatgctggcgcatttggcaatgaccatgccaatggctgatgaggtgaacagggacatgatgatgtcgtgttttggaagatcaaattcctccatcacggaaataagggctgccggaatgactccgcaggagcctgccgtaggagcagccacgatctgacccatgcaggaattatattccgtcacggccagagccatgctgatggcattgcccagaagatgaccgtaatggttctttccttcgtccaccgccttttttagtctggcggcagcgcctccggaaagcccgcttggagagcggagggtttcatccatgccgtctgataccgattgtctcataacttcaaagctgttttccatggtggagtatacggtctcttcggtggtttccatatcctcggcctgctgtgccagcacgatttccgatatttttttattggaagatgaagcggctgccacaagctcttccacggaattatattttaattgcatagattcctcctgttgagtatgcttctgacacggtatcccatttctgcttcaagggaccgtgtcagtttagttttaacaaaattgtgttatatacatgagggatggtttggatctgggagacaagggactggtcaaaatcagaatccatctcaatggtcatgatggcaagtccacgtttttcctgtctgtttaaacggaaattgcagatattggcattgcctaaggccaccaggtttgtgacatgggcaatgataccgggaacatcctggtgcatgacaatcagggtggtgttctgcccggtaaaataaacctccatgtcatttaccttggttataacgatgtttccgcctccaacggatgctccctggacggaaatgctgctgccatcagccgaggttaaggtgacaagcgccgtgtttggatgggcattttcaatggtgccggtgcggaatgtgatggatattccctgttcttctgccgtctcaaggcttgtacggattcccgggtcccaggggtccagttttaagatcccccctaccatggctttgtctgtgccgtgccctttataagtttttgcaaaggagccgtgaaacaggatatctgcctttgccacaggagcacctaagagcagggcggccgttttgccgatacgggcggcgcctgccgtatgggagctggaaggcccgatcatgacagggccgataatatcaaatacattcattgcaatcctccaattctgagcatggtttctctcattcgtttatattggcttgaattccggattgcgtccgcgaaattcagtataataggaaaatccgcattgctttaaaagctccctggctgtatgaaagtccgcgcctaaatcttccggtatgtgggcatcggagcctatggttatgatctccccgcctaattccttataccgcattaatattctgtcacaggggtttggctgtccgatccctttccggagtccggctgtgttgcattcaattcccttaccccgttctataatggcccttaaaatgccgtcaagaatatcccggtaggcttcgtagctgtagtaaagagccttattggggccataacggacaatgtagtcaatgtggcctgccacatcatagttgtcaatatttttcacattatccagtgtggcctggaaatattgaagatatgcctcctgttcctctcttccttcaaaaaattcaggataagcaggatcctttctattaatgaaatgagtggagccgataacaaaatcaaagggataggctgataacaattccctgtaatattcctttaaatgagtctgaagtcccagctcaatccctatgcgaagatcgatccggtccttatattcgtctcttaaggcagacattgcctcaaaatactgatccgtctgaagggtaaaatcaatgacagaatccacgtcataatcatggtggtccgtaacgcagagggatgtcattccaaggcttaaggcccgctctagctgggcacgcatgggagtttgggagtctcctgaaaaatccgtatgaaaatggtagtctggcagcatggggttctcctttcaaaattaaattcattataatcaatctcaggaagaaaagcaacgcaggagagcggagtttttaccgaaaggaatctgataaagtaaaaaaaatcaccttttcagcaaaataattaaattcagtaatccatccgcttgggatatactttaagaaaactacccgcttgaaaggatgggaaattgggatgaaatatgagtttaagggaaaccagggcgatttttatatggaaaatccggacctgaccagttatttatattttcccctggcaaatgagtccggggtaatgagctgcgtatctcctgacctgggaggggacagcaagatggatcagaattcctttttaatgcctcctgtcagctgtgaaaatctacataacgacaaatcctccagaaatgtatggtgcagggttgacggcagggggttatggtccctgaccggccgttcatcctggcagcaggctcagctgttttccgatcataaggaatcagcggctgtggaagcgggcttcatgcatcataagctgaccagaactttaaaacagctgggcctaaaagggactatcagcagccttgttccggccaccggagaaaaggccgagctgatgaagatccagattgaaaatatttccggcgaatataaaagtattcagatagtcacagccatccctctctatgcccgttctgcggataatatcagggaccaccggcatgtgacggctcttctccacagaattaaaacaacaccttccggagtcattgtgactcctgccatgacctttgacgaacggggtcataagagaaaccaccggtcttacggcgtatttggagggaatgaattccagcgtcctgtgggatattacccggttttagaggattttataggggaaggcggaaatcttgaaaatccaaaagccttatatgaaaacccgctgaagcctcagggtgtggattttgagacaggcggctatgaagctcttggagggctttgctttcaggaatgcaggatagggccgaaggaaaaggtaacgtattttgtggcaatgggatatggaaatacggaagaagagctgatacaaagctgtgagcagtttcttaatgaaagggcgtttgacaggtgctgggaacagaccgcagattactggaataacaaggtcaatgtgagactgaacacaggaaaccatgtctttgacctttggatgcggtgggtaagctttcagcccatgctgcggagaatttacggctgttcctttctgcctcatcatgattatggaaaaggaggtcgggggtggagagatttgtggcaggactgtctggcattgctgatgatggattcgtcaggggtccgtcagatgttaattgacaatttcggcggggtgcgtatggatgggaccaatgccacgattatcggaagtggacagggagaatttattgcggatagaaacaacattgcaagggtttggatggatcacggggtatggccctttttaaccacggaattatatgtccatcagaccggagatcttgggatcctcctggaaaacaacagctactttaaggatgttcaggtttgccgcggggaggaaaaggatcttaaatggaaggcagaagacggggagcggcagcgggatggcgagggtcaaatttattcaggaacaatccttgagcatcttctggttcagaacctcacatccttttatgatgtgggagagcacaaccacatcaggatcaggggggcggactggaatgatgccctggacctggcttcccagcgaggggagagtgtggcatttacctgtatgtatgggtataacttaaaggggctggctgattttctggaagagctgaaagcccagggaacggaggaattggaagttgcccaggagataaggcagctgttaacagaggacagggctgtttacgatgatattggtaagaaacaggaaatactggctcattactgcagaagctgttcccaccgcatttcaggaaaaaaagcagtcataaatggagaggaattgcaggcagatctgcgggcaaaggcttcctggatatttgatcatgtaagagaaacggaatggatttcttccaggaatgggtatggctggtataacggatactacgacaattccggaaacaaagtagagggagaaggggcagcagaggtgcggatgatgctcaccagtcaggtcttttcccttatgtcaggagttgcaacggaccggcaggtgggggaggtcgtgaaggcttcccatgctcatctatacaaagaggacatcgggggataccggttaaatacggatttccatgaggtgaaaatggatttaggcaggatgtttggttttgcttacggacataaggaaaatggagcagttttttcccatatggcgacgatgtacggaaatgccctgtacaggcggaatgcttccagggaaggatatcatgccctcatgtcattatttgatcattgcagcaattccgaaaagagcagggtatacccgggaattcccgaatacgtggatgccaggggaagaggggtgtaccactatctgacaggagccgccagctggtatcttgttacggttatcactgaaatgtttggaatcagagggcaatatggggatctggtttttaaaccccagcttttaaaagagcagtttgactggcagcatgaggcatgggcatccctgatatttgccggtaaaagcttgaaggtcatttataaaaatccccggagtctggatccggaaacctataggataaccggtatctcattaaatgggattccctgccaacccttaaacagggattggggcattgggagagaagagcttttaaagctgccgggtcaggagcttcataccattacggttgatttgaatgcagaataagcagaccggattcaaagccaggcggtgcaggggcaggggaatggctgcttcattcaggaggacagagtggatagagaattgattgatatcattaagatttcccaagagggatatacccctcttgtggattatgaaacatggagagtggctgtgctgcggtattgtgatgatgtgagagcagaacgcctggtttccatgcagagacatctggagacagatgaggtgtttgtattgctggaagggaactgcgttctgatttcaggcggaagaggagaccggccgggagaggtggaatgtgtgagaatggtaaaaaaccggctctataatgtgaagaaaggagtctggcatacccatgccctggatgaggaaggaagcgtcctgattattgagaatcaggatacctgtgataagaattctcctactgagcttttaagcagggagcagatcaatgcaatcccaactttcttttgacattccccggcaaaatcgctagaataagggtaaaaaacgtttgaatgggaggctgctatggctggtttgatggatgcatggaggaatatgaggattaagacaaaaatcctgattatgtatttgacagtcgtattattatcctttgtgatcaccttttccgtcatatccgtcattaacagctcttatacgaaaaaagagattcttaatgcaggcactcagacggtcagcgccctgaagggaaacttatccctgatctttgataatgtgacccagttctccaacctgatctattttgatagaaatgttcaggaggctttaagaaatgttgacaacagggccattgatccgtccattcagaggactatcaagcagagcctggtcaatatgatcctgtcaggagaatatatctccagcgtgctgattatggattcctaccataatgtatacagctcctataaaaagacacccaaaggcattcacggggataaggctctggagtctgagtggtaccggaacttaagtgcgcacaatggaaacggtttttttatgaagggcagcgaaggggtcattgaattttatggagacactccctacattacttatatccgtgaaatacgggatgaaaatacatataaaccattggcgatcctgctggtcacggtcaatgaggaaaccatacgcaattactttaacggggtcagtaattccagtgacagccacttttatatcctgggagatgagaatgaatacattgtggcacctcaaaacccggaacagcaaaacagtgaaaaccggctggtgatcacccaggatatcggcattgaaaactggaagctggccggctcctttcagatggataatatgacggccatggcgccctattattccacagttattctgctgatcatgtgccttaatgtaatttttgtatttgtctgctcggtcatgctcacccgttttatcttccgcccattattaaaagtggaaaagcatatgatgctggtggaaaaggggcagtttgatgaaatggaggtggaccggcagaaaaatgaaatcaataacttaaagcgtgtatttaatcatatggcaaggtccattaagaatctgattttaaaggtaaaggaagaagaacagatcattgcaaaggtggagcttgatctgcttcaggctcagatcaatcctcatttcctttacaacacccttgatgcggtatccgcgctggctctcatgggggattatgataattgctttaaaatgacccaggctttgggcagcttttacaggaacagcttaaacagcggattggattttattacggtaaaggatgagatcagctgcattcaaagctatctgaccattctgaatatccggtatgacaatgaaattaaggtagaggtggatgtggaagaagagttaaaggaatgcagaatattaaaactgcttttacagcctttggtggagaacgccgtccaccatggaatcaagccaagggagggaaaaggtaccatttccattaaagccttttccgatgaggatgaaattatttttctggtgtctgatgacggggtcggcatgagcgaagaaaagatcgaggaaattatggatggccggacagtgaccggcaagtcgggattcggcctttataacctgatgcagcggatcaccctttatcatgggatcaagcagccggtccttattcacagcgagatgggaaatggaacggaaatagcagtaagagtaaagcgtatgggagcaaaggggctggagcatggagatcaaagttctgattgttgatgatgaaaaactggaacgggtactgattaaaagaggatttccatgggaagatcatggattttcggtcataggggaggcttcctcaggaatggaagcattggaatttatcaagtacagaaagccgcagctggttctaaccgatatcagtatgccccatatggatggtttggagctggcagaacgtatttcagctctggatgagagcattcatgtgattatgatcacaggataccgggaatttgaatacgcaaggcgggcggtgaagctgggggtggaggattttcttcttaagcccattgatatgaatgagctgaaagaaatcactcttaagatcagggaaaaaatcataaaggaaaaggaccgtaagaatgaggtggagatgttaaaacagagcgtttccgctgaccaggacatattaatggaaagtttctttcaacggctggtagaaaagcggaccagtgaggaggaagcggcaaaaaagctccttgcctatggctgtgaggctctgctggaaggttgctgctgccttaacatccacttaaaggaagaacggccgggggaagcccaggccgggctccataaaagggcgatggacctccttggcgaaaattccattaacggaaccatatcttttcttcattatatgaaaaatatcattctgttttgtacggcaggaagcttaaatgacggcggggaaatcgcctggaagatccatcagatgctggaggaaaatcacattgattccaccattggcatcagccgcagccatcagggctatgagggaattgcagaggcctttgcccagtcggagcatgctctcagcgcatcggtgctgttagggataaccggatcatcacttacgaagaatacatgcacatcatggaaaaaaatccggataagctggcttttgactgggaggattttcttttttccctgaccaatggaatttccgacaaggtgtccgctgcgatcgaggattatgtgagtggggtcaggaattcaagggtaacggaagtggagtatttaaggcttacggttatggatctcatgtcaaaggcgggaagcacccttaataagtatggggtcagcttggaacagctcatcggggaagaccggttgtatgaatccatacagtccatccagacggtggaggagtgccgtccgtttctggatgaatccatccgaatgattctcagctatcataacagcaaaaagacaaagcagggaaataaggtggtaaacgaagccctggaatacattgatgaaaacttctgcgatcccgcgctctctcttaaaaccgttgcctcggaggtctattccaatgaaagctatttaagcagggtgtttaaaaaagaggtgggtcagagtctgattgaatatatactgaaaaaaagaatcgaagagagcatccgtctcctcaataccacggatttaaaggtttatgaaatagcggaaaaggtggggttccgggattcccactactttggtatctgttttaaaaagcacgtgggagtgaccattaaggagtttaagcaaaggtagtaaaatttctaaccttttgggtcaaaatattaaattgagtaacaaagggagtttcggtatactgataccatcaggaaacaaagaaaacccaggaggagattgagatgaagaaaaggttattgaaaagagtttcagccgttgcacttatggtggctctggcagcaggaatgaccggctgcacaggcaaaggcagcgccgctcccacagcagcaggcagtataacagacggaaagacggaaaagaccgtattaaatgtatggcaccagtggtccaatgataccaatgaattgaagaaaaaatatgacgaggcggtttccgcctacttggcggaaaaccccaacatagaaatcaacacccagaccctggatacggaagcttataagactaagatttccgcagagtttgctggagatgcaaaagggatcgatgtgttctactactggggggcaggaaccgcaagaaagatgatcaatgcggataaactccttcctctggattcctatatcacggatgagatcaaggggaaattgcttgaggggtccacggcagcttttgaatacaatggaaagacatattctcttccctccttttcctggtacatgaccttatactgcaataaggctttattcggtcaggcaggagcagagctacccgatacatatgacaaactggtatcagcagttgaaaagctgaaagcccttgacggagtgactcctctggcttccggcgcaaaggatggctggaatgccgcattcatttatcaggcgctggcattaaggaccgtaggggcagaaggaatcaacaagatgctctccggccaggctccctttgaaggagagggttatgcagaagctgccgataaggtgcaggaattatacgagatgggcgcatttggagccaatcctctggaacagagcaatgatgatgccaatgcagcttttggaaccggaaaggccgctatgaggcttatgggaagctggtttgcaaacggcatttatacggataaagccattaccatcaatccggaggatgtggttgcaatgaaaatccccatgatttccggcaaaggaaatgaaaccgattattgcggcggattcgtagaatccttctgggtgaataagagctccaaaaacccggatgaggcggccaaatttgcaatctatataaaccagaagatgggagaggctgcgtaccagacaggcacaggcttcagcggctggaaaacagaggtggatgaaaacggcttaaatcctctctttgtacagatcaaggatcttctttcccagggtaagacctcagtccttgcatgggatacctctcttgatgcggagcctgccaccatccataatgaacaggtgcagaccttatttgcaccgggagcagataccggtgagtttataaaggaacatgaagcagctattaataagtaagtaagagcaagggggtatcgcttacaaaaacaggcgatacccgttttttgcccaaaggagattgattatgaataacatgttgggaaaaaagagctttgtggcctgctttgtgctgcctgcgctcatcctgtttatcagcttcagcatcatccccctttttatctccggagcctacagccttttccagtacgatggcatggggaaaatggagtttatcgggcttgggaattatatcaggctgtttgcagaggaccgccactttgtgaaggccgttttaaattcctttcttttagtaagcgcatccttaatcattcagctgcccatttcccttttactggcaatggttctggcaagaggggtaaaaggagaaaagttcttccgcacggtttactttttgcctgtggttatatccagcatggtaatcggtcagctgtggatgaagatgtttaacagcgaatatggacttttgaataacttgatccgggcattgggagcttctgatttcaattattcctggctttccaatcctaaaacagcatttctctccacattggttcctgctgtgtggcaatatatcggctatcatatgctgatcttttatgcagggatcaaatccatttcacaggattattatgaggcggctcaaatcgacggagccagcaagtggcaggtgaatacaaagatcaccctgcccctcctggcccctgttatcaagacctgtgtcatattctccattaccggttctttgagggcctttgatctcatctatgtcatgaccgggggcggacccaaccatgccagtgaagtgccggcaaccctgatgtacaataacttattccgcagaggcttatatgggtatggaagcgcacaggcatttttcattgtagtggaatgcctgctgtttacctttattgtgagcaggctgtttaaaaaagcggaagaaaatgcatctgccatataaatgaggaggcggtcctatgaagattaaaaaaaagataaagtttttgctgctgtgcctcattgcactgactcagcttttccccttatactggctttttaccttttccttaaaaagcaatggagagattttcggagaaaaccccatcgggctccccttggtctggagatgggaaaattatggaaacgcatttacccagacaaacctgatccggtattttttaaattccgtattctattccatggcgacagtggttgttgcaggacttttgtctgccatggctgcttatgccatagccaggatgaaatggaagcttaaatccctggtattcggagttttcgcattgggaatcatgattccggctcaggctgccctgctgcctctgtttcaggtccttgacaaagccggtttaaaaggcgggtatttagggcttttgattccttatattgccggggcgcttcccatgagcatcatgatattaatcggattttacaaaagcatcccaatggaaattgaggaggctgcctgcattgacggctgcgggattttccggtgttttgcggccatcatacttcccattgtcaagcctgctcttgccactgcctctatttttacctttttagggacctggaatgagctgatgttagccaatacctttgtggacagcgaccggtaccggaccctgcccgtaggcatcatgtcctttgcaggccaatattccactgattggggcttaatcggagcgggcatggtcatagccaccctgcctaccattgttatttattttatgctgagcaatcagatccaggatagcctggttgcaggtgcggtgaaaggatgataagactatgtttgattcaaaaggaagatttattatagaaaattatagccaaaagccggtattttccagctttttgccgggaatcagcggaatttacggcatccctctctggtgtttttataccaacaggggtcaggcagttgcaagctttggagtggaaaacaagaatcattccattatggagttttatccggcccaccaggcataccagcttgtgaggaacatggggtttcgcacttttattaaggttgggagcgagttatacgaaccctttcggctggattctgtgaagacccggatgtatgtgggaatgaatgagctggagctggaagaaatcaatcatgatacaggcttaaaaaccaatgtcctgtattataccctgcctgatgaagagatagccggtctggtgagaagggtgacagtacaaaatatttcccggcaggagctgcggctgcaaatactggatggaatgcctggaatcctcccttatggcatcggattaaaagaaatgaaggaaatggcacagaccatgaaagcctggatgcaggtggaggacgtggaaaagaggatgccttattaccgggtaagatacagtacaggagattctgcagttgtttcaagggtggaaaagggaaatttcatggtttctttatcagagttcgggcagctgctgccaataatcgcagatcctgagcttgtgtttgaacacgatacgtcattggaacatccgataggcctgatccgtcacagccttgaggaacttctgcaaaaaaagcagatcactcaaaatcttgtgccttccggttttgcctgtatgaccaggatcctgtctgccggtgaggcaatggagtggaacagtgtggcaggccaggcctcaaccaaaaagatcttgtcagattatgggaaagggaatctggacaggagctatttcgaagacagatacaacagggcagcagaaaaaacgagggaactgggaagtttcattgatacgaaaacctctgatccggtttttgatgcttattgcaagcagacttatatagataacgtgctgcggggcgggtttccaataaaagcagggaaggattccgtcttttacgtgtattccagaaagcatgggatatggaacgggattacaatgatttttccatgtttccggaatattactcccagggaaacggaaatttcagagatgtaaaccagaaccggagaagcgatgttttattcacgccctatgtaaaggatcataacatcaagctgttttataatctgctgcagctggacgggtacaatcccctggtggtccgccagatcacctatcaggccctccggactgatgagattcttaaatttgtgggagaggaaggcagaggctctgtggaaggatttttccaaaaggagttttccccgggaagtctgttcgcttttctgggacaccactccatttccttaaaatgcggcagggaggaattcctcagtgcagtgacagagcacagcagacttaaatttcacgcggattttggggaaggatactggactgaccactggacatatcacattgatttgattgaagcctacctttccgtttatcctgaaatggaaaaacacctgctgttttctgataaaagctacacttattatgaatcaagggcggttgtaagaccgcgccatgagcgttatgtaaagacggaacggggatcaggcagtaccacgccctttgtgaggaccggaaaaaagaagatttaaaggaaacggtattcactgatcatggaaagggaaccgtttatgtcacaaacctgatgacaaagctggcggtaatagctgccaataaaaccgcttccttagacatgtccggcttagggatagaaatggaaggggaaagcccggctggtacgatgcattaaatggactgccgggtctcttaggctcctccatgccggaaacctttgagctgtaccgtctgctgaaatttatggaaagcgctctggaacggtttgaagaaggggttacagtgccgggcgagctgtatgattttatcaaaggtctggataaaacctttacaacctatgaggaagaagctaaaatcaagctgtgggtatggaatgagtgcaatgattacaaggagcattacagagggattattgccaaaggagtccggggagatgaggcattcatttccggacaggagtttctgggaatccttgggaagtggatttcctatgtggaagacggcatccaatcagcctgcaaaaaggatggaaggattcctacttattttattcatcagtttgacagctatgaattggctgggaaccatatcattcctgaaaatctgcaggtcactgcccttcctctgttcctggaaggatttgtccggtatatgaaactgcccgtatccagggaagaaaaattgtccttgtaccaaaaagttaaggaaaccggattatatgattccaaattgaaaatgtataaagtcaatgagtccctggacaatgccccctttgagatcgggagagcaaaggcattttcacccggctggctggaaaatgaatccatctggcttcacatggaatataagtatctgctggaattgctcaaatcaaaattatatgatgaattcttccgagattttcacaatgcatgcattccgtttttggatgaagagagatacggaagaagccctctggagaattcttcgtttcttgtgagcagcgcaaatgccgatgataagcttcatggaagaggctttgtggcaagactcagcggttccactgctgaattcctgcaaatttggcagattatgatgtttggagaaaagcccttccgcataatagaggggcagctttgctgtttttttaagcctgcaattcccggatatctcataccggagaacaaaaccgttgaagccagatttttaggaaaaaccagggtcgtctatcagttttttgagaagcaggatatgattccgggctgctaccgcattgaggggatggaactggaatactttgatgggcaaaaatcagaagaaaaggaagccgggctttttggagcggctgccatgaaactaagagatggaaaggtgaaatctcttgttataaagcttggaaaagcaaagggtatctcataggttaaataggctcgctcctgcattcataccagtcgtaaaattctgaaaggttaaaggttacatatgaacattcttattgagaagggaacaaaataccatattgatcagcttgagcagctctatgacgatctgaatgactttctggagaacagcattaactatcccggttggataaaaggcatatatcctacacgtgaagatgcagttaacggtattgcaaatgacaatctttatgtagcaaaagctgaaggaaaaatcgtgggttcaatgatattaagccatgagcccgaacctgcatatcataaggttcaatggggaatacaagctgactgctctgatatatttgtgatttatactttcgctgttcaccctgggtatcttaaaaatggaattggcatggcattgatgaattttgcggttcagcatggcatgaaagaacacgcaaaagccatccgccttgatgtttatgaaaagaacctgcctgctgtaaggctgtatgaaaaatgcggttttaagtatgtggatactgtggatctggggctaggaaaatatggacttcattgctttaagttatatgaaaaaatactgtaaatttctccgcggcaaaagccgcccgctggtttccggtcagcagggcggtttttttgtcggaatggggcagttgttttacatagatttcacccaaattttacatattttttaaaaaacattgaaaaatcaattccgcctatgctatattttaaacggtgcgtcttccggaaagggagaaaagcgccggaataaaaccataatcagtgtttataaggaggtaacacatgtctataaatgacatatcgagtctgtttggttttctagggggactgggaatgttcctgtatggcatgaacaccatggcggatggaatgcagaagagtgcaggaagcaggatgagccggtttttgggaatgcttacaaacaaccgtttcctggcggtgctcttaggggcgctcataacagccatcattcagagcagcggggcaaccacggttatggtagtgggttttgtaagtgcaggagtgctgaatctgacccaggcggtaggtgttatcatgggagccaacatcggtaccaccattacggcctggattgtatccatgaatcagctgggagatgcattttccatattgcagccttccttttcagctcctctttttattggaatcggagcggtccttcttttgttcggcaaaaagcagaagatgaaaaccataggggagatcctggtgggccttggcatgctgtttatcggcttggattttatgtcaggagcgatttcaccttataccgatgctcccattttttctgaagcattccgccttttagggagaaaccccttgctgggtatgctgatcggagccatggtaacagcactgctccaaagctcttccgcatcggtgggaattctacagactcttgccatgaacggggtggttactaccaatgcggctattttcatcacccttgggcagaacatcggttcctgtgttacagccctcatttccagtatcggcggttccaggactgcaaagcgtgcggcagtgatccacttgtcttttaatgtgctgggagccgttactttcggcataggttcctttgccctttttatggtctccccggcgttggcggcccataacattacggcggtacagatttccatcttccatacgttttttaacctgacaaacacccttcttctgttcccgtttgcaaagcagctggtgaacttatccgggttgatgatcccggaagacagaaccggtgaaggggaatcggcaggggaagaagccgtgaccatgaagcatctggatgagagaatttttgaaaccccggcttttgctgtggaaactgccgccatggaagtagtacatatgggacagattaccatggaaaatgtgaagcgggcaatggatgcggtcataacgaaaaatgcggatgaagcgaaagaagtgtataaaacagaaaagacgatcaataatatggaaaagatgctgatcgaatatctggtcaaaatcaacaatctgtccctgacagaggagcagaaactggtagtcaacaacttattttacagtgtcaatgatatcgaacgggtgggtgaccatgcggagaacctggcggagcaggcggaatatatgatccggcatgaaatcagcttctccgatacaggtgcttctgatttacaggtcatctgccaggcagcctacaaatctttcttccattccatagaggccagaagaaaaggggacatggaagatgtccggaaggtgagccagtgggaagatgaggtggatcttttggaggaagagctgagagaaaagcatattgaacggctttctgcgggagagtgcaatacttcttcaggcgttgtgttcctggaacttataagcaatctggaacggatttccgaccattcctataatctggccagctatgtgaagaatgagctttagggtaagcggggaatttaaaataaaaaaggacttgctatttactggattattaggtaaaataaagggtagttgattattatttaacaatcaaattaattttattcttaggaggaattgaattatggcagtaaaagtggcgattaatggtttcggccgtattggccgtcttgcattcagacagatgtttggcgcagaaggctatgaagtagtagctattaacgatttaacagatccaaagatgttagcgcatttattaaaatacgacactgcacagggcggatacgctggatactatggtgaaggtattcacaccgtagaggcttccgaggactccattactgtagatggaaagaccattaaaatttatgctcaggcaaaggctgctgaacttccatggggagagatcggtgttgatgtagttcttgagtgtacaggattctattgctccaaggacaaggctcaggctcacattgatgcaggcgctaagaaggttgttatctccgctccggcaggaaatgatcttccaaccgttgtttacagtgtaaacgagaatatcttaacagcagatgacaagatcatctccgctgcttcctgtacaacaaactgtctggctcctatggcaaaaactcttaacgattatgctccgatccagtccggcatcatgagcacaatccatgcttacactggcgatcagatgatccttgacggacctcacagaaaaggcgacttaagaagagcaagagcaggcgctgccaacatcgttcccaactccaccggtgctgcaaaggcaatcggcctggttattccggaattaaacggcaagttaatcggttccgcacagcgtgttccggttcctacaggctctaccaccatcttaatagcagttgttaagggtacagacgtaaccaaggaaggcatcaacgcagctatgaaggcagcagcatgcgaatccttcggatacaatacagatgagatcgtttcctctgatgttgttggcatgagattcggttccttatttgatgctactcagaccatggtttccaagatcggcgatgatttatatcaggttcaggttgtttcatggtatgataatgagaattcctatacaagccagatggttcgtacaattaagtactttgctgaattaggctaatgatccacaaagggtccggtcgttatggaccgggccttttattttttaatgtttgaaataacagtaaatggaaataccttccaggtatccctttacacccgataatgcggggtgggccctgcccagaaaacgtgggcagtaaataggaaaggagcattgaagcatgcttaataagaaaacagttgatgatttatccggattacagggaaagaaagttttagtgagatgtgatttcaacgtaccgttaaaggatggagtgattcagaactttaacagaattgacggagccgttcctacaatcaagaaattattggatcagggtgcaaaggtgattctgtgctcccatttaggaaagccaaagggcgagcctcttccggagatgtcattagagccggttgctccagctttaagcgaaagacttggcgtagaggttaaatttgtaaacgatccaaaggtaacaggtcctgagacaaggaaggttgctgaggaattaaaggatggagaagttctgcttcttcagaatacccgctacagagtggaggagacaaagtacggcaaggatgagagtgcagaagagtatgcaaaagagctggcgtctctttgcgacggtatattcgtaaacgatgcattcggtaccgctcacagagctcattgctccaatgtgggcgttaccaaatatacagccaccaacgtagttggttatctgatggaaaaggaaatcaaatttcttggccaggcagtggagaatcccgtacgtcctttcgtcgcaatcctgggaggagcaaaggtttccgataagatcaacgtaatcaataaccttcttgataaagttgataccttaatcatcggcggcggtatggcttacacctttgcaaaggctcagggcaaagagatcggtaattccttatgtgaagaagacaagcttgattatgctttggagatgatcaagaaagcggaagacaaaggcgtaaagctgctgcttcctgtagataacttagaaggcaaggagttttccaatgatacggaaagaaaagtggtagaggtcattgacgcaggctggtcaggctttgatatcggaccgaaaaccatcgaacttttcaagaatgctttaaaaggcgccaagaccgttgtatggaacgggcctatgggagtatttgaattctccaattttgcagaaggtactttagaggtttgccgcgcagttgcagagctttctgatgccactacggtaatcggaggcggtgattccgtgaatgcggttaagagacttggttttgctgacaagatgacacatatctccacaggcggcggcgcttcccttgaattcctggaaggcaaggaactgccgggcgtggctgcagcagacaataagtaagagaaaagggagatcccggtcttctgaatgacgaacataaaggaaggttgatactatgtccagaaagaaaattatagcaggtaactggaaaatgaatatgactcccaccgaagcggtggagctggtaaatacattaaagcctctggtagcaaatgatgaggtagacgttgttttctgtgttccggctattgatatcataccggctatggaagccgcaaagggaaccaatatccacatcggcgctgaaaacatgtactatgaggataagggcgcttataccggagagatttctcctggcatgttaaaggatgcaggcgtgaaatacgtggtgatcggccattccgagagaagggaatactttgccgaaacagatgagaccgtgaacaagaaggttttaaaagcctttgaatacggcatcactcctattgtttgctgcggagaatctttaacccagagagaacagggaatcactcttgactggatccgtcagcagatcaagatcgctttcttaggtgtgccggcagagaatgcggcaaatgcggtcatcgcttacgagccaatctgggccattggtaccggaaaggtggcaacaacggagcaggctcaggaggtttgtgctgctatccgtgtgtgcatcgctgaaatctatgatgaagcgactgcagaagcgatccgtatccagtatggcggttccgtatccgctgcaagcgcaccggagctgtttgcacagcctgacattgacggcggcctggttggcggagcatctttaaaaccggaatttggaaatatcgtaaactacaacaaataagtatataaaagctgctgcccctcttccttaatcggtggggcagcagtttttggcccaggggaaaataccaggcatcagagccctgatattattttgtcattcaccggttgcaagaaatgtgcaaatcatgtaaaatgtaatctgtgagacaatgatttccataagatttcccacattttggagcatgatgatatatcaggatgcttccattacaatagaatgaagaagaggaaaaggagaactagttatgagcagaaaaccagttgtattaatgatacttgatggttacggattaaatgataactgcgatcataacgctgtttgtgaaggcaagacccccatcatggatcagcttatgagccagtgtccttttgttaaaggcaatgccagcggactggcggtaggtcttcctgacggacagatgggtaattcagaggtagggcatttgaatatgggcgcagggcgcatcgtatatcaggagcttaccaggattacaaaatcaatagaagacggcgacttttttgaagttgcggaatttttacaggcagtggaaaactgcaagaaatccggatcagcccttcatatgtggggtctggtatctgatggcggggtacacagccataacacccatatttacggcttgttagagctggcaaagagaaacggtctggacaaggttttcgttcattgcttcctggatggacgtgatacacctcctgcttccggaaagggctttgtagaagcactggaagaaaagatgaaagaaatcggcacaggcaaggtggcttctgttatgggccgttattatgccatggaccgtgataaccgctgggaccgtgtggagcgggcatacaatgccctgacaaagggagaaggaaaccatggggaatcggctgctgccggaatccaggcttcctatgacaaagaggtttatgatgagtttgtggagccatttgttgtgacagaggctggaaaacccctagcaaccgtaaatgacggcgattccgtgatcttctttaatttccgccctgacagggccagagaaatcaccagagcgttctgcgatgatgaatttaagggatttgccagagaaaagcgcttaaacctgacctatgtatgctttacggattacgataaaaccattgataacaaggtggttgcctttaaaaaggaatccattgcaaacaccttcggtgaatttttggccaagaacaacatgactcaggccagaatcgcggaaactgaaaaatatgcccatgtaacatttttctttaacggcggtgtggaagcgcctaatgaaggagaggacaggatcctggttccgtctccaaaggtcgccacctatgacttacagcctgagatgagcgctcccattgtttgcgacaagctggtggaggctgtcaaatccggaaaatacgatgtgattatcattaattttgcaaacccggatatggtaggccatacaggaatcgagaccgcagccatcaaagccattgagacagtggatgcatgtgtgggaagaactgtggatgccatcaaggaaacaaatggcattctgttcatctgtgctgaccacggaaatgcggagcagcttttggattatgagacaggagaaccttttactgcccataccaccaacccggttccgtttatcctggtaaatgcagacccatcctacaagctgagagaaggcggatgcctggccgatatcgctccgactctgatcgaactgatgggattagaacagccaaaagaaatgacaggaaaatctttacttgtgaaatgagtttaggaagttatgtcaaaaaagggctttccagtgctgcactggacggccctctttttttctccaagtgaatcaatgggatatgtttgcccattcagggttgaagacatttttctttcagccttgaatgtccggctgaggcagacaaggttttttaatgtaaattgaaaaattaaattcgtccatattcgttttatgcttccatttcttatgaaaatacgatagaatagagaaagatatcttaggaagggtttcagatgagtattcgaatcagattttctttggagccaaagaaaaaaattttctcagggattagctggaattgccagtcggcagaaggtatggcaaaaaagctggcaaaggaaatggggtaccattgttttcggatcgaaggttttttgcttgtccagctgtgccaggaaggctatatctggcttaagtggagcaggaacaagcttcagggggagagtcagactaacattgccggcccaggttttcatgcggcggccattcattttctggagaggcttgcaaaagaggaaaagctaaggctaaaggtcgaggacaggaccggatattatatgaaaagggattttcttgccatgaggcagaagcacttttatcagtggttttctgaccttatgaagctggtgtccggatggggcgaagatggggaatacatgttttgctggccttcggtttattatgtaccggaccgtcaggagggaaaactgatcacccatattcggtcattttcttttaaagagataaaagggatgatacattctggtataggggtcgtatttgccagggatttttttgtatggaatgaactggaaaaggatgcctgtttttacagaaacagtgccctggtcctgcttcaccagttctgctatttcatgccgtcaggccgaagcaaacaggatcagcaggtgaaccgggagatcatcgaactccttgaaaagacgctttccatggatcgcaagcttccctttccaaagaaagaatatttggaggtatgcagccttgacggccatattcctgtggatttgaaaggcgtggtgtccttgacggaggaggattccatcggctgtcgaaagcatctggtttaccggaagatcggcaatatgagctttgggatcccggggaattttctttacgatgagtcatataacggcaccatggaccactactatgacggaaaagggtatgggggccatgattattacgtttacgcagcggtttttgaaggacgtaaggctgagtttaagaagcagtggtttgagcaggggaaagggcctgaaatcatggactttgacgtaggagaggccaaggcccgggcggcattttatgagccggaggaacgggaaggagaaatcctttatgggatgtcagcacaggtattatataaggaacagcgtatgaacattaatattgtgagcagaaagccgggggaaaaagattgggctttagggctcattaagaatattaagattacagagtagaggattatatgaaacagaatgagatgcgaacgggcacattgctgaagcgctttgtgccctattataaaaaatatacgaaagtcatgatcatggatttattctgtgcgtcgcttaccaccatttgtgaaatggtgcttcctttgattctgcgttatatcaccaatcagggactaagagatatcacaacccttacggtacagatgatcgtaggaatcggcgctctttatttcggtctcaggatcatagacggaatggccagtttttatatggcttacacaggtcatgtcatgggagcggccattgagacagacatgagacaggatgcatttgcacatttgcagaagctgtcggataactattttaacaatacaaaggttgggcagatcatgtcccggatcaccagtgacctatttgatgtgacggaatttgcccatcactgtccggaggaattttttattgccttcctaaagacagtggtatcctttattatattgtcgggaatcagtcttcctttgacgcttattattttcctgttgatcccggttatggcagtatcctgtacttactttaacttacaggtgagaagggcctttaaacaccagagaaaccacatcggagagctgaatgccaggatcgaagacagccttcttggaaaccgggtggtccgggcctttgcaaacgaaaagatcgagatcgaaaaattcaacaaggataatctggaatttttggagatcaagcggaaaacctataaatacatggctgctttccagaataccatccggatgtttgacggcctgatgtatgtggtggtcattgttgcaggcggtatatttatgataaaggggctgattgagccgggagatctggtggcttacaccctgtatgtgaccacgcttcttgccaccatccgaaggatcatcgaatttgcggagcagttccagagaggaatgaccggaattgaacgatttatggagttaatggatgccagcgtggatatctttgatgaagaaggggcaaaacctcttcatgatgtaaaaggaaatattacctttcaacgggtatcctttgaatacccggatgaccataatccggtgctgactgatgtgaaccttgatatcaggccaggagaaagagtggctctagttggcccttccggtggcggaaaaaccacgttatgcaacttaatcccccgtttctatgatcctacagagggtgagatcctcattgacggccaggatattaaaaatgtgaccctggagagcttaagaagcaccgtaggcgtggtgcagcaggatgtgtacctgttctcaggaacagtttttgaaaatattgagtacgggcatccgggagcttccaaagaggaagtgatccaggcggcaaaactggccggtgcccatgaatttataacagggcttaaagatggctatgatacttatgtgggagaacggggcgtaaagctttccggaggacagaaacagcgcatcagcattgcaagggtatttcttaagaatcctcaggtgctcatccttgatgaagccacctctgcacttgacaatgagagcgagcatctggtttcccagtccctggaccgcctggcagtaggccgaactaccttgaccattgcccaccgccttaccaccattcagaatgcggaccggattctggtgctgtctgacagcaatattgtggaggaaggaaatcatgaggaactgctgttaaagcggggtatgtattatcagctttatacttctgcaggtgaggaagagcagactgccctgacagtgtagtcaaatattattgcctacagaactaaaggagaacggaaatgaaggtagcgatagtaacagacagcaacagcggaatgacccagaagcagggggtggaagccgggatttatgtagtgcccatgccctttatgatggctggggagacgttttatgaggatatcagcctgacacggagggatttctatgaaaagctggaggaaggggtagatatttccacctctcagccttctcctgcggatatcctggatttgtggaacaggcttttggaggaatatgaggaaatcgtccacattcccatgtccagcgggttaagcagcgcatgccagaccgcccttatgctggcagatgattacgagggaaaggtgtttgtggtcaacaaccaaaggatttcagtcacccaaaggcagtcggttctggaagccaaaagcatggcggattccggtatgaacgctgctgcaatcaaagagaagctggaagacaccaagctggattccactatatatattaccttagatacgctggaatacttaaaaaagggcggcaggatcactcctgcggcggctctattaggaacatttttaaggatcaaaccggttcttaccattcagggagagaagctggacgcctttgccaaggcaagaaccatgaaacaggccaaaaccatgatggtcacagcagcaaaaaaggatatggaggagcgtttcggtgatccggaagggcttcgcaccggcatagccgttgcccattccaataacgaagcggctgccatggaatttaagaaggagctggaagagattttcccgaagacaggggaaatttacgtggacaatctttctttaagcgtatcctgccacattgggccgggagccctggcaattgcctgtaccaaaaggctggacgtatgacagaaatgaagttggaggtgggcggacatgttccagataaagatttttaatcagaaacatgccatgagcctgcggttcaccctgatcatcgttcttctggtggtgggctgcatacctataatgatccagaactcggtcatgctgggggcttaccagcagaacctcattgagtccagaatgcaggaaattcaaaaccagtgctggatcttaagcaacaagatgacaaggatcggatacttgaccatggagccaaaggacccgcttcttgacaacgaaatgtccgtaaaggctgatatgtttaatggacggatcgtggtggtgaaccggaatttcaggatcatcagcgataccttttccctttccgtgggcaagcttaacgtatctgaggaggtcatccggtgttttgacggggaaaacagcagcaagtataattctgaaaagcattattcagcgctgaccatccccatttattccaacagccaggaaaaagaaatcgcaggagtcatgatcgtgacggcatctacagaggatctgctgaaccggatctccattgtgtcggaaaaaggacaattccttcagctcatgatcgtttccgttctggccatatttgtggttttacttgtaaagtttctgataaaacccttccgggagctgcagcggatgctgaacagggccgcggaaggagatatggatgaggaggtcagtacctatgcctataaggaaaccatgcagattacggagaccattaacctgaccttaaagaagctgaaagcggtggaccagtccagggaggaattcgtctcaaacgtttctcatgagctgaaaacccccatcacttctatccgggtgctggcggattccctgatggggctggaagacgtcccggcagaactttacagggagtttttaagcgatatatccgaagaaatcgagcgggaaaacaagatcattgatgaccttctgtctctggtccgcatggacaagacttccggagggaatttaaatatcgctcaggtgaatattaacggcctgctggagctgatcttaaagaggctgcgccctattgccggaaaacgcaatgttgagctgacctttgaaagcattcgggaggtcactgccgatgtggatgagatgaagctgtctctggctttaagcaatctggtggaaaatgccattaaatacaatgtggaaggcggctgggtccgggtgacccttgatgcggatcataagtttttttatgtaaaagtggccgattcagggatcggaatctcagaagagttccaggagcatgtgtttgagcggttctaccgggtggataaggccagatccagggaaacaggcggcactggccttggtctttccattacgaaaaaaattgtgctcatgcatcagggagcattgaagcttcagagcaaagagggagagggctccacatttaccgtacggattcccctcacttatatttcttagaaacaggaggctattagatgaaacgcctttcaggcatcactttacgcccggtacaccccataatacggggtgcgctgaagcggggcgggttctgccccggcatacgggcagtcataataaagcggctgaccaccgttctcctcctggcctgtgttttatgtctgaccggctgtgaaaaaagggaaggaaaggaaacggaagccattgctgatgtttatcagatttattacttaaattccgccatgacaaagatggagccacaggagtatcagatgccccaaaagccggagggggacttggaagagctgacggactggaaaatcagaaacttaatggaacagcttcgtaccgtgccaaaggacttggaccggcaggccgctgtcccggataaggtgggctttgagcggtataagctggaggatacggtcctttatctgtattttgataataattatgccatgatgaatgccaccagggagatcttatgcagggcctctctggtaaggactctgactcaggtaaaaggggtggattatgttgccgtatatacggcggaacagcccctgatggacagctccggaagtccggtaggccctatggcaaactctgattttattgacaacatcagcaatgtcaattcttatgaaaagacagaactgcctttgtattttgccaatgatacaggggagaagctggtgaaggagacaagggaagtggtgcataatgtaaacacttctctggaaaaactggtcattgagcagctgattgcaggtccgggcaggccaggtttgaatccgaccctgccaagggatataaagcttcttaatgtgtcggtcaatgaaaacatctgttatattaattttgattccgcatttcttaataacacactggaggtaaaggaatacatcccgatttattctattgtgaattccctggctgcggcctcctccgtcaataaggtgcaaatcacggtgaacggttctcaggaggtcatgttccgggattctatttccttaaaccagctttttgaacgggacctggattacaatgcggaaaatgaagaagtaccagatgatataggaggaacagaacaataaaacgcccattatgtctgatcgcagggggatttgtacttggagagactgctgctttgctggttatgacatcctggcttttgattccggcttttttagctgccgggattgttctttatggttattggagaggcagaaaccggctttgggttcttttgcctcttctttttttattccttggcgcggcctgggctgggcaagacagggaaagatggaaaggacgggaagcaaaggcagaacgaatatcagaggcctatgtggaagttcagggaaaggtgtcatcactggaagaagtgaatggggtattgaggctcaccttgaaagggaaccaggtgtgggaatatgggaaaggcggaaggaatgaagactcccggcttctccttcccggcattctcgtgacaatgaaatcaacctttcagatgaaggaagacgaattatgtctggggcagatcgtaaggatcagaggagaggctcagcctttctcccaggccagaaatccgggggagtttgattccaaagcctattatcaggcacagggactggactgcaggctttccggggaggagctggagatggtaaattctgatccttctcccctgcttgaggggctgcgacggatcagggagcgggggaaagaaatcctttaccggtatggggaagaggatgatgccggaatttttacggccgcagtattgggggataagggcggcatttccagggagattaaaactctatatcagaaaaacgggatcgctcatcttctggcgatcagcggccttcacatgtcctttgtggggatatttctttaccggatactcaggaaagccggccttggctacggcggctccggtctggccgggacgattctgatcgttctctacggaattttaacagggggaggaccttcggtcatgagagcggttattatgatgagcacgggatttttagcctcctatcttgggaggacgtatgaccttttgtctgccgcctccatggcactcctgcttttggccgttgaatcacccttcttatcactcagggaggggttcagctatcctttggggctgtctttgccataggaggggtgagtcctgtaatagagcgctggatcgggaaggaaaaacccctggcaggcactgtgtccgctgccttagccattcaaatggtcaccatgcccttcctgttttatcatttttatcagattccgctttacagcctttttcttaatcttcttgtgatcccactgatggggggcgtactctgctctggattcgcagtaatttttcttggaaatgtaagccctgtcatgggtgtttttgcagcaggaacgggacattatattctggtcttatatgagttcctttgcaggaaagtgtcccaacttccaggctatagcctgaccttcgggagaccgggggcagaacggatgatggcttatgtttttctgatgcttgcagggctggtgcttttggcagtgtcggggaatgaccagggggaggcaggaggagaaaataaggctggggagaaagcggagaaaaaaaactgaggccaggaaaaaggaagaggagaaagaaaaagaaaatggaaagggaaagactgagacgaaggaaaaagagaataaaaaaacaaaggtaaaggaaatttcatatccagggaaaatgcttattctttttgtgatgtattgcctatgcatcctaatctttaagcctggcccggtaaaggggctggaagctctgttcattgatgtggggcagggggacggcattttgcttcggacggagaagttttcagtgctggtggatggaggaagttcttcaaaaaaatctctgggagaatacacccttgaaccgtgcataaagagcctgggagtttccgtgatcaattacgcgtttatcagtcatggggatctggatcatttaagcggagtagaatatcttttagaatcctgcgatgacataagaatacaaaatctcatgcttccttaccacggaaggcaggacaagtccgtgatcaggctggcagagcttgcagggaaacgggggacaaaggtatggtacttaactgggggagacaaaattcaggttggaaagctccggatcacctgcatttaccccaaagagtcggatgtaccggaaaataccaatgaggaatcagaagtgcttaagatggattatggaaactgccatatgctgtttaccggcgacatgggagaaaggggggaggaacggcttcttgagcggcctgtggaaatcaggatgctggaagaggtcaatgtgttgaaaaccgcgcatcacggctctaagtattcatccagccaggcatttcttgatgtggttaagccgcggtgggccgttatatcctacggggaaggcaattcctacggccatcctcatgaggaagttttggatcgtttggagagacagaaggcagaggttttaaaaaccggtgtgagcggggcaataaggatgtggacggatggggaaatgatccggttcacaagtttcattgacggagatggattctcccggtataataagaggaaatgaggttggacaaggctttctttcaaccttgagatgccagttaagcggatatgcaggcatatcctttaactcatcagtatgcaaaaatgagaggaatgacatcatgcagacgctgactcaggatatcaaaaatcacagcttcaagccggtctatcttctatatggagaggaagcatttttgaagaacagctataaaaatcaaatgaaggcggccattacggcaggcgataccatgaacttcaatcagtttgaaggaaaggggatcgatgtgcgggagatcatcagcctgggggataccatgcccttttttgcggaaaaacgcctgattctggtggagaacagcggcttttttaaatcagtttctgaagaaatggtatcttacctgtcccagttgccggataccacctgcctgatctttgtggaatcagaggtggataagcggagcaaaatgtttaaaaaggtaaaggagctgggttatgcagctgaaatggaacgccaggatatggctcagcttgccagatgggcgggaactttgctctccagggaagggaagaagatcacaggtcataccatggagctgcttcttcacatgaccggggatgatatggaaaacatccgcatggaactggaaaagctcataagctatactttgggaagagaggtcattacagatgaggatgtggaaaccatctgtacggttcggacgaccaataagattttcgacatggtggcagcgatcgtgaaccggcagaccaaaaaggccatggatctttatgaggacctgctaaccttgaaagagcccccatgaggatcctgtttcttattgccaggcagtttaatcagattttgcaggttaaggagctgatgggaaagggaatggataagggcggtattgcctcaaagcttaaaatcccccctttgcagcaggaaagatcatgcctcaggcaaggaccttttccagggaacagattttgtcttatgtaaacttgtgtgtggaagcggaagaggctgtgaagacaggaaggcttaatgacaggatggcagtggaattgctgctgacacaaaaatattaggctttaaggattaaaacaggtaaaatctggttattttatttggaaaggaggtcaggatggaagacttactgaaaaaagagcagataagagtatttttatcaagactgctgcttgccatgctggttattatattttataaaattgttataaatttttcggacgcagtgatttggttaaaatcatttacaaaggtgctcattccctttttttatggatttgtcatagcatatctgttaaatattccatgttccgccctggaacggcgtttgaacaggcctggatttggtccctttagaaaaagttccagagggatcagcgtttttattatttatgccctgtttattgctgccgttgttctgatcataaacacggttatacccctgctccagaaaagcatattggattttatatcaaacttcaatatttactataataatgccatcatgttcctggagcatctgccgttggaaaaactgggcctgtcggaaatggtggaaaatattctgccgccccagactgcctggaaaactatgctggagggagtcggcctgaaagaagtattgggttcattaagtgcggttctgggtgtgacttcccatattttcagcggatttattacgattgtagcttccatatattttctcctggaaactcataattttaaattccaggtgaaacggctcatgaatttgtttcttcgtgaaagggtcaggaaagcagttttaagatacggaaccataatcaatgacagttttaaaaaattcattgtctgccagcttttagattctttgattttatgtaccataactaccgttgaatttaccatacttggttccagatattcggtagcccttggaattatattgggtatctgtaatattgtaccttattttggctctatttttggctccattggtgctgtaatcatcattgcatgcacaagcggaatcaatactggggcaatcgctgccctggtcttacttgtcacccagcagctggatggaaatgtgatacagccaaagcttatgggaaactcattttccttaagcccggctttgattgtcataggaatcactttaggcggtgcaattgcggggatatggggaatgattttggctgtgcccgttgttcatatactgaaggtcattgccggggatttcatagcggtcagagaagaaagggctggtgaggcctgtgcaggtccctataaagtcactgcggatcctgctcccaaggtctcgtccgatggtaatgaataaggagttgtctcattttattgtatagctggtttattgctttgaatcaattaggaaaagcaggttcttcggaatctgcttttctgcttgaagggtaagaatggagcgctgctctttaagatgattgttcatctgttatgcagcacttcattctttatggatcggatttttacgaaatcccctttttatggctatcatttacattcgctggtgtctttttcatcatcgcattcacagcagagatcctgatgggctgatatggtacccagtgtgtcaccaagctgtgagaatattgtgcttaataaagcaagttcatcggaagaccggccttctgcgatgcagcaagccagggaagatacaagcattacaagttcacaggattgcataaataaatcacctctggatagtatatgtggcagagaggcgacaagacagagaaaacctcacactagcttgtaaatattgaaaggttcaaagaggattaagtaattgtctttttgtaatccttttccgtattttgcctgatagcattgaagggcctcctgtaaaaactcttccgtcacatttaagtgttccgcaatttcatatccatttcggcatcccgcttccttggctgccaccagcctttctaaggttatcattttgttgtaggcccataaacgggcggtgcgttcctgcttctggtttgatacatcagactggtccagaatgtctccggtagtggtatggtagtgtcccagctcttcagccaggacacaggccttctggcagtccgtcatatcctggcggatcaggatctgggtgcctctgatcctgccgtcgttagctatgagcggccgttcttttatgatgattccgtgggaatccgcttcttctaataaagattcatagttcaaataaatcacctcaatgagttatttcttattcatcaaaaaaggcatcatcatgctgtttcatttcttcggtcaccttgatgtcagttctttcatgagctgctaccggttctaagtaagccctgttatttccatttaaaatttttgcaatgttttgttccttgctgtattcagggatatggaccatctctctgacgcgttttaaggcttccttctgtcccttttcatttaaatggtgaaaattctcaagcatttctcctgcatatttcccaaaacagccgcttacgtagttaaatgcggaagcagtatcactctcccagcccatgagataggccggcgtcgtctttaaggcattggcaatggctataatctttgactggggaagccccctcccgtctacttcgatcttgttgatggaagaccgggatttgtagcctgcttttattgccagttcttcctgggagagtccaagttcttcccgtcttcgtttaatgatctgtcctatttccaaaggatcacctccataagaatattatatcatggtgtagaagaaaattcaacaaaaattcgaaacggtgttgacaaatatggtacagtggagtatgataatgaatgtagacaatatgactacaaaagaggaggagatcgtatgacagatacggttcggctaaataatgagatcaaaaagtccggactgaaaaaggggtggatcgcggcagaactgggtttgtccagctacggattttggaggaaagtaaacaatgagaaccagtttaaggcaggagagatcaaggtgctgtgccggttgcttaagattacgtcattgaaaaagaaggataaaattttttttgctgacgaagtagacataatgactacaattggcggcggagaaaggaggttttatatgcagaatagaaatgagcatagagaggttgaaatctagtacaatactcaagattaagattatacaatttttttcccattatcttatacgagtattaaactgcaattaatatcgcagctagtaacacaatcaatataaaaaaggagagatacttatgctattaaaaggcggagataagggtattcaagtaaaataccttcagcaagcattaaaaatcatgtgctgcaatccaggttccattgattctgattatggaccaggcacacaggcagcagttgaaaagtttcagcaagagtggggcctgggggttgatggaatcgtcggtgataagacgtggaattgccttgttgatgaaattaagccgattcagcaggcattaaaggataaaggcttttataaagaagcaattaccggtattgctaaggaaactacctatggcgctgtcatttctttccaggaaagccgtggattgacagccgatggtatggtaggcaattctacccgcgcaaggttatttaatgatgaaaatggtggagatgatttgatgcttccacttagtactggagataagggtgattatgttttatatctacaacacggtctgcgtattatgtgctgcagcccaggcagtattgatggtgtgtacggatctggtactgcggcggcagtatcaaattttcagagcaaatacggcatagctcaaactggcacatgtgatactacaacgtggaataaattaaaacagttaattatagaaatacagaagcgtcttcaaaacagaggctataacgttcccttaattgatggtattgcaacatctgctttggcagaagccattaagcagtttcaggaagcgaattacttaactgctgatggtcaggttggtccttctacctatgatattcttatgagtgatattccagatggagctactgatgctttaccgcttaaactaaaatcacgggggccgagagttctatatttccaatatgctctgcggattaattgcattaatccaaacggcacagatggtgtctttggggctggaactgaggctggtgtaaaacgttatcagaccaaagccggcattacttcggatggaatcgttggtacagctacctgggagcagatgcgtaaagatattacaccaattcagactgcgttggggaacaagggatatgatgttggatttgttgacggcatagcaactgataaggtttataatgcagtactaaaatatcagacagaaaatggtttaactgccgatggtatggttgggacggcgacaaaggctatgcttttaggggggacttcaggcagcggcacaatatcctcaacattaaaggctggatctaatggttctctgaccttatatctgcagagattactcaatgaattaggctttcaggtggcattaaatggaatttttgataaccaaactcgtgatgctgcgattgcgttccagaacgcaaatggattggtagcagatggtgttgtaggtggaggtacatggaaaaaactctttgaaatgtaccatgtgaacgtttctggcaaaggtgttgaaaagctgattcatgttgcaaaacatgagttggagtgggaatttaaagaagataacgccaataatatcactccttacggccagtggtacggaatgaatggaagcgcttggtgtgcaatgttcgtttcttattgcgcttatcaggctggtgttattggcgatttggttccaaattatgcatggtgtccgtcaggtatgacatggtacaaagaaagaaacagatattataagcgtaatagtggatatattccaaaacggggagatattattttcttttacaataacgagcttggaagagttgcccataccggtatcgtaattgagggcgatgacaaatatattacaacaattgagggaaatacaagcttggatcgcgtgcagaagtgcacatataaccgtaaccattctacaatagacggatatggcagcaatggcggggaagcgatagaagtcccaaaaccacctacagagaaagaaatagaaagtgtactgctggattattacagggagtttttaaaggtatgttatgtcgtactcccgtctgataagattaagttaaaccaggcagttgaaattcctgtgccgcctgatagcaagattattgttgaggcaagtgcagaatctactttgtttgacaatagtgctaataactccggttctatagtatgtgatattagcaatgggagggcaatgtcagggcagatagatcttaaagataagatttctatttccttagagggatttgaagaggcccaaagcatcttggacattgtatttgatataaattcgtctgttgaagtaggtgcttctgtgcttgaatcaggactaagaagtgacactacaggaaattgggtgtatatagcatacactattaaaaaagaagtccaggttaaagatggttttccaccgattgaatttgcattcaaatatacatattgtgtaaaaattgaaaatggtggaggtacttctgtgtttgaaccagtctttgcatttgttgaaaaatataaatgggaaattgcaaaagttggagctggaatattggtagttattgcagttgtcattgcagttaaggcaggcgtgatagcggcaggagcaggaggattagccacgcttattgcaaatattttaagtaaacttgctcaagttgtctttgcttaattcagaaaggaaggttgcctctgttttcataggcaacctttctctccatatttatttctcaaattttatctttttagcactgatacatttcttttttaaaaatttcaaccagtcctctttggttatattaattaacgattcttttgttatgatcactggggttcctgccttggttgcaatgaaataaaagttttttgtttcaactattttgataaaatctgaatatgggacatgaacagatatattcatggcggcaatcgttatgcaaaggtcgtcttcacgaaagctaagctggtatacaatattttccgtatgcaaatatcctttcatcatttgtatataccgattaacaatagaaatcaaactgtagagatatattatataagcggataaagctaaaagaagaaagaaaaacgatataaatggcgaagcatggaggatttcatacacagattgacacataaaagtaacacatactattgcggttaaagggcgaataaagcaaggaagcagatattttcttatttccatcaaagaatctttatttgagatccctactgcctcaattgaatattccatacgctaattctcctcactgtatattgtataatttgattttattattcctttctaccacataatccagccattcatatttatgattttcattaagaaaaattttgttaataggaaaacacatgttctcacgagtgaataaagcaatatatttttttgtttcaacaattctgctgatatttgaataatccatattaaatccagatccttctgtttctttcgatattgtcaggtagttattgtaaaaatgcaatttataattaaaatcactttgccctggttttaatatattgttgagttctttttttataagtatttccctgaggatgattttttcaatatatagaaacaatgcacctacaaaaaagatactcgtgattaaagaacttctgagtaggaaaaagagaaatgccagcattccagataaaaatatcgccatattcaaaaaaaacgtaaattttggcggatataaatatttttttaagctgtttagtgcctttttatttatagatccatttatcacataataagatcccatacgatctcctcaaattttttattaatattatactatgcaagttgcgccgctgtaaatgatatattaccatttgtctgagttgatcgaaaatattatttattcagataatgaacagtaacatatattatgaaaagaagtccacagtaaagccggttcttcctgggatatccccggttatttccaccttctattaatgatctttcctgcttcaacaggattatctcagtaggagcattatgtcacgttgtagaaaaaagttcaacaaaatttcaaaatactgttgacaaatatgggacagtggagtatgataacgaatgtagacaatatgactacaaaagagagggaaagatagtatgacagatacagttcggctaaatgatgaaatcaaaaagtccggactaaaaaagggctggatcgcgatggaattgaatctgtccagttatggattttggcggaaggtaaacaatgagaaccagtttaagacaggagagatcaaggagttgtgccggttacttaagattacgtcgttgaaaaagagagatgaaatttttttactgaaaagtagacaaaatgactacttcaagcgatgaggaaaggagcatttaatgaaaataggagattgggggaaggtgaggagccccacacaaatgcaatatgcccggtatgagaaaagtctggtgcccaaagggagggctggtgctgtatgaaaggaggattttatgtataacgaaatcatggagggagtcctgaaaaggctaagagagctttttccggagaccaggatcggtacaattcccttgggggagggaattgctgaaccatattttgaggtcgggttcctggaaacatcagaaaaacctgtaaacggtcagcgttatttctgcagcgtgagcgtgtatgtgaaatattactgtcaggatccagaacagcggctaaaggacaggaatcttgttctggaaattctgatggacaagctggaatacattactctggaagatggctccttaataagaggcagcagcagaaagggaaaatatgaggaggctgctttaaatttcctggttgattatcaggtctatattttaaaagccagagaatcgcaggaatccatggaagatataaaaataaagtgaaagaggtgttgttgtggcaaaaaaaagtgtaaaagaaacgggcgggactgtcgttgcacgtttcacaaaggatcagctgatccgctcggaaaggtatcgcaatcaaagggacttattaagcgctttgcttgacgatagaaaagtatactctgcaacagaagcagaagaaattatgaatcgatttatgaaaggaagggtgaaagtatgttaggtggaggaaattttacaattcaaaataaggtatttcctggtgcatatatcaattttgtcagtaccgcttcagctggtgccgccatgggaagcaggggagtggcggcaatccctatggttcttgaatggggaccggagaaggaagtgtttgaggttaccgcagaggattttcgaaaaaggtgtaaagaaatttttggctatgcaatgaacgatgcagcgatgcttccagtaagagagcttttcagaaatatgacaaaaggtattttctaccgcttgaatgcaggggtacatggggccaatgattacggcacggcaaagtactcaggtattcgtggaaacagcctgatgacaattatttctaaaaacgtggatgatccttccaaatttgatgtaaaaacactgcttgccggaagagaaattgattgccagacgatcacagaagcaggagaactgaaggataacagctatgtgatatttaaaaaggagtctgctctggcagagacggcagggcttccgtttacaggaggcaccaatggcgctgatgtgacaggagaggactacgcagaattcctggaaaagatggaaaatgccttcttccagattctttgctgcccttccgcagacgataatgtgaaggctttgtttacagcatttacaaaacgcatgagggatgaggccggcgttaagttccagacagtattacaccagtattccaaggctgattacgagggagtcatttccgtggagaatgaagcagaggaatcagctgtagggcttgtttattgggctgccggtgcagaagcggcttgtgctgtcaacaagaccattgaaaataaggtttatgacggcgagtatacagttaagacttcctatactcaggcccagcttgctgatgccataaaagcgggcaagctcatgcttcacaaggtaggaagtgaaatacgggttctgactgacagtaacacattggttacttatacggaggaaaagggagaagatttctctaacaaccagacggtacgtgttctggatcagattggaaatgatattgcatctcttttccatacacgttatctgggcaaaatctcaaacgatgatgctgggcgggtaagtctttggaatgacattgttacatatggaaagcagctggcggtgttaggggccattgaagcagtgaattcagaagaagtaaccgtggaaaagggacaggacaagcggtctgtcgtcgtaaatttaccagtgaaaccgattaattccatgagcattttatacatgacagtagttgtttcataagaaaggggtaagaaaatatgagcaatattacaatggacgcgtgggacgcgatcagcgccacaaaagcagagtgttttatcacaattgaaaatgagcggtacaattttatgcaggcactgaatctggaggcaaagattgaaaaggtgaaatcagagatcccgattctgggacgggccatgaagggaaataagaccgtgggaatgaagggaagcggatctgctacttttcattacaatacaagcattttccgggatattttatacaagttccagcagactggaaaagatatttattttgatattcaggtaaccaatgaggatcctgcttccagggtcggccgtcagactgtgattttaaaagattgcaacttaaatggaggcattatcaccaaatttgacgcaacaggggaatatctggaagatgagtttgaattcacatttgaaagctgggaaatgccggaaagattcagcaaccttgcgggaatgcagtaaaagaaaaaggggataagaggacatgggagatttaagttgttttttgagccagaacgcagttaaggcagagcatgaaaaatatgttgcctccaaacgctttttaggtccggacaaaaaaccggtggaatgggagattaaagcaatttcctctaaggaggatgaagctctgagaaaagagagcacaaagcgggtttcagtgaccggaaaaaagggacagtatacccaggagacggattataacctttatcttggaaagctggcggcagaatgcacggtttaccctaacttaaatgataaggaactgcaggattcctatcacgttatgggggcagacgggcttttaaaggccatgctgactgcaggggaatatgcaggttatctggaacgcattcagcaggtaaatggttttgatatcactctggaagagcaggtggaagaggcaaaaaactgatagaaggaggtgatatggaagcaaatattgcctactattgcctccacaagctccacaaatggcctcatgagtttttgagcctggaccggtatgaacgggcgtttattatggctgcagtacagctaaaactggaaaatgataagaaagaagcacaaaaggcgaagtctgcagggaaaagatagaaaaatggaaggacacctttcaaggtgttcttctagaaaggaaaggagggaaggtatatggcaacaatacaaaactcaatacagcttcaggatggagcctcctccatattaacgaggatcaatcattcaatcaatatgactagcgagtcctttcgaaagttccaggtggcagcagataattttatgggtctgccgggaatatcagcatccgtaacggatatccatagcatgggaatccagtttgaacaggttacggaagtaattgtgcaagccaaagagcagcaggaagaattaaataaaagcatagatgaaggcaatgacaaattccagaaaatgaagaaactctgtgataaggcattatctggtctgggtaagatgggaatcaacaccagtccaatggaaatatttaaccaggcaaatgatataaaagcagccggtaatctcatacagtccaggaccggaatgcagggacaggatttagaggcggcaaaacaaagcacgaaaaacctgtacgtggataacataagcggaagtccggaagatgccgcaaagagtttatcatccattcatcagatgaccggacagacagggaacagcctggaacagcttacaagagcaggattgctcctggaagatacttttggttacagcctggcagacagtatccgtactgcaggagtgctgcaagcgcagtttggagttaccggtgctcagtcattggacttaatcgtgcaggcaactcaggcaggtcttgataaaaacggagagcttttggatacgatcaatgaatattctccccagtttaaaagtttaggccttggcggagctgatatgtttaacatgctggtcaatggagcacagaatggagaaatttcagtcagcacgttaggcgacgctgtaaaggaatttacatcaaggactgttggaggaggaaaggacgcccgggaaggtttttccgctttggggcttgatgctgcaaagatgacggaagctttcggaagcggtggcgatacggcaaagcaggcattccagcagacgatagccgctttaagcagtatggaagatcctgtgaaaaggaatgtagcagggatgaaattgtttggcagcacctggggagcgttaggcagcgaaggggttatggcattgtctaatttggatggctccgtacagctgtcaacggaacatctggaagaattaaataatgtaaaatacaatgatgcagccagtgcactgagctctttggctaaaacagtcaatatggggcttgccggtcctataggcaatatggttgacaatgtgaccaaagccatcagcagctttacagccggacttaagggaaatgtcggtgaaatcaccgggatttttggaaccattggatttgtggccggaaccgtgggtagggcttttgcagaagtatggcctgtgatagagcctgttttgtggggaattattggggcgttgattgtttacaatgcaacgttgaaagatgggtggattgctacaataaagaatgcagctggccaagtgtggaagacgatctgcgattgggcggagactgcagcgataattgcattgatagctgcccaggacggattaaatgcagcattagctgcctgccctcttaattggataattatgtttattatcattttgataggactgttttatgcaggtgtggctgcctttaataaattcgccggaacctcttacagcgcaaccgggatgatatgtggcgcaattgcggtagccgttgcatttatagccaatgctcttatgggaatcctggaaatcgggtttgggattattgagtacttttataatggctgggtagcttttgcaaactttttcggaaatctgtttcatgatccggtagcttcggtaattcacttatttgcagatttaggtgatacagttcttggcgttatacaaaagatagcacagggcctggactttgtatttggtacccatatggcagataccgtgaaaggctggcgggataatttatctaatcttgccgatcagcttgctgaaaagtatggaaacgggacctatgaggtcaaagcagataaactggacatggatcaggtattggctgattttggtataccactgaaacggtggaattatggtgataaagcccataacggatatgaatttggaggagagttgggagataacataaaggataaatttggcgggataaatagtttccttgacaggaattcctcagaatctggtctgcctggtgtaactgacagcattgcccaaagtaccggagatacagctatgaatacggcagctatggcagactcaatggatatcatggatgaggagttaaagtatatgcgggatgctgcggaacaggaaatcatcaaccgatttacccttgctgaactaaaagtagatgtgaataacaacaacaccataaagaatgtagctgatattgatgaaatgtatcgcagactcggtgatgctaccaatgaaattcttgcttcagctgcggaaggagtgaacttttaatggcatatgaagtttatattgatgatatgcttctcccgttgccgccggaaaagatccctattaaatatagcgggcaaaataagacggtgaacttaataaatggcgaagaaatcaatttgatcaggccctttggccttgcagaaatcggaattgatgcaataattcctcaaatggattatcccagcgcagtttgggatggcagcattgacagtgcagaagattttctggaacggcttcaggagttgaaggatggcaaaagtccttttgaattcaccgttatccgccagggaacgggaggaaacagcctttttgataccagcattgatgttactttggaagattataaggttacggatgatgtgagtcaggggcttgatctcatagtgtcccttacaatgaaggaatataaaaattatggaactaaaattatgaatttttctattgttgaagaaaatcagaaaatagagtctgtacaaccgcaggaggaacgtcagggagaaccgccgccggtgaaaacttatgtggttaataagggagactgtctgtggtccatagcgaaaaaacagcttggcaatgggagccggtggcaggaaatccataatctgaaccgggataaaataacaaatcccaatgttatttatccggggcaggttctcactatgccataggaggtaggaaatggaagtacatttatatatccagaacggtcagaccgtatatgagccggtagtaaaaggagccattacctgggaaactcagcgcagagggcagcccggaaagtgttcttttaccttggttccggacaaacgcctccagatcgaggagggcaacgccctccgtctggatgtggatgggaaacccgttttctttggatttatttttgagcgtaactggagcagtgatggggaaatgaaggttactgcttatgatcagctgagatatttaaaaaataaagatacctataattacacggatttaactgcaggagaggtgatccagatgatagccagggattacaatctaaacacaggagaattagaggatacaggggaacgaatctccagaaaagaaaaggataaaaccctgtttgatattattttaaacaatctggatctcgctatgatacatacaaagaacttgtttacattttatgacgatgcaggaaaactgactttgaaaaatatgaataacatgaagcttgacatcatgattgatggcaaggcggctcaggattatgactataaggtcagcattgacagcaatacttacaaccagatcaaactgtattgtgacaacaatgatacaaagcaaagagaaatctatatgacaaaacatactgaaaatatcaacaaatggggaattctccagaaagacgagtccattgataaaggggtagacggccaggccatagcggaaacatatttaactttgtataaccgcccttccaggactttgactgtaaaggatgcttttggagatatccgggtgcgggcgggctgcctgattccggtgttcctggatataaaggacatggagttgaaaaattatctggtgatcgagtctgtgacccataaaattgatgagggagtacataccatggatttgacattaaggggggcgaaggtcagtggctgatgtggaatggatcgaaaatataaaacggatcgtaattcaggcaatcgaagcgggagatccatgtgacgtgataccaggaactgtaattaaagtaaatcctatggaaatacaaattgatcagaagacaatcctgtccgaatcacagatcattctgctgaaacaatttacggaccatacggaggaaatgaatattcctggaatcggtcaggtggctgtaactgtaaaagatgggttaaaagcaggtcaaaaggtgcttctgcttcagaagagaggcgggcaacagtatgtggtaatgggtacgtggtaggaaaggaggtgttgccatgcttccggtgacaggtaatattttagagcaggatattaaggtggtccagatgccgtcaaaaacctttcgtcttgatacggaaacaaagcgcgtggtcggaactgtagatggcttggaggcgataaggcaaaccgtgttctgtattcttaatacagaacggttcgattggctgatttacagctggaattatggtgtggagtttaaaaacttatttggaaaatcaacagggctggtaaaggcaaagatcaaaaagagaatcaaagaagcgttgcagcaggatgaccggatacagagtgttgatacgttttcttttgaaagcaatgggcagtcgcttcatgtaaggtttatggttcataccattttgggagaaatcgtagttgagaaggaggtgaacatttaatgtatgaggatatgacgtatgaagttattttgaaacgaatgctggatcgggttccaaaagaactggatagaagggaaggatctgtcatttacacagctttagctccatcagcagcggaaattgcaattacatatattgagttggatcatgttttaaaggaaatgtttgctgattcagcaagtcgggaatttttaattcgtagggcagcagagcgtggagtaataccaaaagcagctacctatgcagaattaaaaggagaattcaatgtagaaatatccattggtagtcgtttttcatcagatgttttaaactatacagctgtagaacgattgggtatcggtgaatacagaatgcgatgtgagacaatcggagcagctggtaacagcaactttggcagattaatccctattgaatatataaaagggctgacaaaggcagaattgacggaattattaatacctggagaagatgaggaagaaacagagcgatttcgcaagcgatattttaatagtttaaaatcacaggcgtatggtggaaatatagcagattataaagaaaaggtatctgcaatttctggagtgggaggggtaaaagtctttcctgcatgggccggtggtggaactgtgaagctggttattattgactcatcttttagtattcctactgaagatttgattcaaacagtacaggatcaaattgacccggagccgaatcaagggaagggttatggactggcccccattggccatgaggtaactgtagttggcgcagagggggagaaaatatccattgtaactaatattacatatcagacagggtatgatgccggtcggtgctatgatgatatcagtaatacgatcgatggttacctggcggaactaaacaaatcctggcaggagtttagtgaaaacgtagtgaggatttccagaattgaaagcaaactgctggatgtggaaggaattcttgatgtgtttgatacatacatcaatgggaaaagtgaaaattatgttattccatcggatagaatagctgtgagaggtgagattcatgtatgatcggagggaaaatgatttaaactcttatttcccagagtacgttaaggaaattgttgagtttaacactatcgcgaaactagaggcggaagaactcaaaaatctttatgatagctgccggtatatttgggaagctggattcattttgacgacagactatcagggaataaagaaatgggagcagtttttagatttaaaaccagatcctcaatttacgcttgatgagagaagatcagcagttttggcaaattggaattaccaacttccttactccagaagtaaattaagagagcagctaacggctttgttaggtgaagactacgaattatatatttttcatcatatttataaattgaagcttgtagtgaaggagagaccaataacagtcttaaaaagtattcaaggaatgattcaagaaatggtaccagctaatttggaaacagtttttttcagtaaatattctggaaactataattttcagacttcttgtaaaaattcaatccgctaccggataggtttttatcctcgctacaatctttcgtacttatatttggataatctctggccgttaaatggcagctgtaggctgaatgggtataacagtagagaatttatcgacttttacccgataagatccagactggaagcgaatgtttcagaatttgttaaaggagcagaacgaataaaggtaccgacggtatttgtggagcagagtaacacaggtaataacatattgagatttaaaactgatttaaggagagatatacaatgcaaaatgaaagcagctttattatttgaaacagaggaacaggcaacagcaggtacgatccgtgttatgaacataaatagggtgaatagcacttggaaattagatagcaggcgaaagttaaatggtggcttatcaattttataagagaggaagagaaaaatgacaaatacatcaaatggagtaataacaacaacaggaaggaagaagttttgcaaggctcatgccggggatataacactcccaattatcacacatatggcatggggagacggaggagtggatgaaaacggacagcctaagacaacaacaggcaatgaaatcgggctttataatgagctgttgatgaaggagatcgaaacccatgcatatgtaaatgatatggaatcgacatgccgttttactgctactctggataaggacgagcttacaggaagagaaatatcggaaatggggttgtttgattcggatggcgatttaattgcctatcggacatttatgcgtaaaggaaaagatgcagacatcccgcagatctatgatatggatgaaatcttttaaggaggttaaattatgatattttgcaatgtaaaaaccccacctgaatatactatggaaatcagaaagtgggatagagagactctggcagatggtcaggaaatggcttttgagatagaacagcttttcaataatactttctataataagatgattctggagcagcatgaacggccgatagaggtcattattcctgcctctggttggagcaatatgattccatacagccagaaaatcgcggtgactgggataaaagcatcagataatcctataatcagtccatgtactccaaaggaattatcaccggcagaggtaaaacttagaagaaaaatggttggaatgataactgacggtgaaacagaagatggatatgtaacgttttactgtgcagaaaagaagccgaccggagatttcagcgtgtatttgagggggtaagtgataatgggtaaagtgattatcgccggagctggcggatcaggagcaggttctgatgagtgcacagcttcaaaggcagaggttttaaaggggtatagagcaattacatcagattccgctgatgaagtggctgaaggaacattggaacttactggtgacgtgtcagatagtcaggtactggaaggaaaaacatattataattcgaatcccaaaattaagagaacaggctctatggtaaaccatggtgcggtggccctgaatttgaatgctggtgcttcgtatacggttcctgctggttttcacaatggggcggtaaggtgacagctaacagtttggcaagtcagaccagcgcaacggctgcggcggcacatattttaagcgggcaaacggcttgggtgaatggaagtaagcttacaggaaatattgcctctttggcagggcagacaattaaccctactgcttcccagcagacggtttccagctctgggaagtatatgactgggaatgtggtggtgaatggcgtgtcaaaccttacagccgcaaacgtcaaagagggagttaatgttggcggtactattggcacaatgaaagactattcttatctggcggtagggcaggtggctttttaaacggcacgttctcgggtgtcctctctgggggcgtgcagtcgacaggaacagatagaggaggattttatatttccacaggaacttatccagggatatatttaagagggaaatactacaatagcaatgatggtgatgattatatatactctcaatatattgtaaactctaagagtgttaacctgacgccatttagccaactgaaggttacatttagatctaattatgggcgagggtcagatggactgggtggggagtgtcgcattgtattactaaatacaagtaagagtaccattaaatcatccagtcaagtaagcggcggctattttgtttcaacagtggtttccttagatgtatccagtataaatgtgcaagcatttttcagaatacaatctgaaagcgtaatggcaacctatggtgaaatgataattgagaaaattgaattcacaaagtaataataattaatacgaggaggttttttattgaaggtttcagtcatttatgatcatgaaaatggtcgtatattagccgttcaatatggccaggagatggcaagcaaggacgttagaaatattattgttgaggttgaagacggggaacagttaacaggccttactattgatgaagatactgttgctcccatcatagaagagactcaaatgtcggttttgacgaaaacattgaagatgatgaatgctcggatagagtacctctccatgatgtcaggcacaggaacggaggtagacgatgagtaaaaattttgaaaaagtaaagagtttttatgattctgaactgtggtcagaggaaatggtgtggaactcggtaggccgctggatcacagtggaggaataccgggagatcacaggagaagaatataagaaagcgtgaggtaaatgagaatgaaaaatatattatgtacagctgcaggagcagcaggcagtttcatagtgtctgtatttggagggtgggataccgcaatcggaactttaatacttttcatggctgttgatttcctttcaggcctggcagtagccggagtgttccataaaagtgtaaaaacagaatccggaacattagaatcaaaggcgggctttaaaggcttatgcaggaagtgtatgacgctcctgtttgtgctggtggcccaccgcttagacctatccctaggcaccccctacatacgagacactgtcatcatcggttttatggcaaacgagctcatatccatcgtagagaatgcaggccttatgggcctgcccctcccacaggtcttaatcagagccatagacattttaaacaagaaatcgcagccatcacaataacgataaaaggcccatttcagcccggtacatccccgccctttccgtcatattataataataaaaaggacaaggagacattatggttaaaagtgaggctacaaaagatatgccgaacatggagctgctgggaatacaggaaaatctaaagaatgccgattacacggaaatagaacgtttccgggaatcttttgatgcggatgagatggggttcgtgggcataagggaagggatttaatatggaagttcacaaactattgacaccatacaactacagcaacggtcagatagaccgaattaaatatatcgtgatccactatgtaggggctttaggaggagccgaagcaaactgcaaatattacgcctcccaatacatcggagccagcgctcattattttgttggcttcagcggagagatctggcagtccgttgaggacaaagatattgcatggcattgcggggcaaaaacatatatccatccggaatgccgaaacagcaacagtctgggaatcgagctctgtgtcaggaacaatggcagtcagtcagatacaagcagagactggtattttgaagatgcaacagtaaaggccgccgcccagctgacaaaagagctgatgaagcattacgatgtcacggcagatcacgtaatacgccactatgacgtaacgggaaaaatctgccccaatccttacgtttacaatcacacccagcatacgtggaatgattttaaactagcattgacagaagcgccccagaatcaatccggatggatagaagaggagggcggctggaggttctacctgggagataccggaaactatgttaaaaacgactggtacaaggacggggaaaactggtattggttcgatggtgccggatatatggtaaaagatacatggaagaccggatcagacggcagatggtactatctgaataacgacggtgctatggcaaaaagccagtggatcatctggaaggaagaactataccgggctacagaagacggaagcatgctggaaggaaaactgtatctgggtacagatgaaaaaggtgcactgcacattatctgaaaataggcgggagtccggaaaaatccggccccgcctaaagttatgtataccgcccaaagatggtggaaattatccatacgctatgttaaaatgatttgtatgaacaatcattgtgctgtccccggatattccgctaatgatgctccaatgaatcagcggcagcaaaatatttcctatttcaaaaacaacagtcagagaggtatccctatgcagtattacaagcgaaacccgatcccatttatttttatattttatgccatttgctttgcattccgggcgatggaatatttcctgttacgtactgaccagtccataatcggggaagcatttatacataaactggccggtattttcctgctggcagctgccttgccatttttccggtattcatggtcagaaatcggttttacttctcaaaagttgttccgcaatattttattgggaactttactgggcaccgttgtttttacagcaggctatggggcagaaatactgatgcagtcggcagcaggtaattccccggtacttaagctttacgtgaccagctattccattttaggcagccgtgagatgaaaaatggcctcctgttccttcttatctgcgtagcaggaaacatgatcaatgtgattatggaagagggagttttccgcggattgtttgtccggctgtctgaagaaagacattcttttcccgccgcatgcatgctctcctctgtactctttggaatctggcatattatgcagcccctaagaaatgtaatagacggcagtcagtctatggaaggcgcattcttagccggtctggtactggtggtcaccagcacattgcttggcattcagtactgcatgctttgcaggcttacaggatccctatgggcaggaatggcagcgcattttgtgaataataccacggttaatctgctgcatgtggttacggcttccggtgtagatgaacttttgaccattcgcatcaccattgcccagaccctttcttttctcattgtgctcttcctttatatatcccgttacaaaaagaaatgagccaatccggtacattccattgttccctttaagaaccttataatcctaagctttccgacaggtccggtcgccgggcattttctccctgcagccttgctctcaacaccaatgattcaatgcctaaatgcataaatatctgaatccttgatccctgcccctaatcctaatcccaaaacaaccgctaccagaatataataaggtcaatgcttccgctgccagcaacaaacagaaacacaacggaatataagaggaatgtagaaacaataagtaaaaagacagaaaaaggagcatgagcaaaatcccagtcgttccgctgcattataaaagtctgagaaatagctgttcaaagaactgccctatactaaaatgcataaaaatattgataaaaatacagcatttataacaaataatataaaaaacattgacacagatctaataaaatgttattttgtaatcatcaaaaacgttttcgtaaataacgatttcgtacaacacttctaaaagaagtgttaaaaaaaatcaaaaaccaaaaacgtttttggaaaaagaggtgtgaaatggcaaaatcaatttacgatgtggcacaggaaacgggattatctgtaagtacggtatcaagagcgttaaacggatacagtgatgtatcggccaaaaccagggcgcgcgtggtggaggctgcggaaagacttgggtatgttccaaataccagtgccaaaaatctgtcttcaaagaacaagaaaaatgtggctttgctcatctgcggacttttggaggaagcccagtcaaacgagttcatgatgaatgttatccagggagcttatacctacatgatgaagcatgagatcaatcttgccatgtattccattgggaaggaagaacaggaaaaaaaggattttgacacattttgcagagaatattcattgtcaggagccgtgattatgggactcaggataaccgatcctttggtaaaaaccctgcctcattccaccctgccctgtgtttccattgatattccgctggacggagcatgtacgtcggctgtcatgacagatgacagaaaggcgtttgaacagatcacgcagtatgtgatcgaccatggacaccggaagctgattcttgtctatgggcggaagaagtctgatgtttccatcaggcgtcagcaggggtacctagacgttcttgaaaaaaacggcattgaaccaaaaagctgtaaagtgatctatacggattttatggagcagaaagcgtatgaaggaacgaagaaactgctgaaagaatatgggaaagaggctggcaccgcttttatctgcatgagcgatttaacggccataggagttctaagagcagtacaggagctgggatacgagagcccggaggatttttccatcacaggttatgacggcaactattttatgaaatacattgacccctttgttactcgcatcaaccagaatatgtggcagaaaggctacgacgcggcaaaacttctcatgaaaatggtaaatgacgaaaagtattcaaagattcatatgacaaaatattttcttgaggaaggcaagagtgtaaagcaattgtaaataaatattaaggaggattcatatgaaaagcaaattggcgggatttatggcggctgttatggcggctgcagcattgatcagcggctgctccggcggaagcagcaatacaactgcatcaggagcgggaaagggggaaaccggatccggcaaggaaatccagatgacttttccaacctatctggcaggtgaaaatgtaggggctgttttcttccttcctgaggtagaacggtttaatgagaagtatgcgggcaagtataagatcgtgattgaagaggttccccaggcccagtatgcggaaaagattaaacaactggcccagcagaacaagcttccggccatagtccatgcacccggttccggcggaattgatctgcagtggtttaagaacgtggctctcgccaatggcatggcatatgatctgactgaatttgcaaattccaatccagaggtaaaaaagaactggattgacgaatccatagattactgtaccgtagacggaaaactgatctgcaagcctctttccgtattaaagcctgtgggccttttctataacaataccatgtatcagccggaaaaagcggttaaggatatgactcttgatgaatttacggaaagcatcggagataacaggatcgcgttccagactgcggaaaacgcatggaccacaggacttcttctcactgcccttattgccaaccaggagggaggcgaggggtacctggctcagtttgtggatgacaagctgtacgattatactgacgaaaaaatcatttccgcgacaaccattctgcaggagctccttcagaaaaatgcatcggccaataccattggtgcagcttatgcagatgcagccaatgcatttatgagcaaaagcgcagccattatatgcaacggttcctggatggcctcagactttgatgaagcatcagcagacaagtggtccaacggatttaccggtgaggaagtgacctcagatatttatcccggcaactttgccattgcaaatccaagagtatttggtgaattctggatcgcggataccgcttctgatgaggaaaaagagctggcaaaagctttctttgccttccgtgattccaaggaagaaatcgaacagctggtcttgaccgaagggggagtggctccaaagctggattacagcgacgagtttttaaagaaacaggcggaaaaccgaatcttatcccagcttgctgaaagcatggatggaaatacaaaatacacggcatcaatttttgatgtgatgccagcctccgttgctgatacggaatttggaaagctgcttcccaagctggcggatggaactcttacgccggaggaattttgcagccagctgactcagaaggctgaggaagcaaaaaactaatagcaatatgggaattaaatactgttgcaaaaagcctgtaataggggtgtattgcagcagtattttttagaaagaagggaagaaaatgaaagcaggaaagtcaaattccaccgttttggagagaaggaattataagtggtgttacttatttttactgccctccctcttaatatttttgctgttttacttatcgcccatccttacggtgatcgctacatcctttaccaagtgggatggctttaacaaaccggttttcataggacttaaaaattacatagacctttttcattcaaaaacctttctcatatccttgaaaaatcttcttgcctggtcaatgattgccgccacctttcatgtggggtttggcgtacttatggcatttgttctgtacgcaaaacccaggggctggaaattcaccagagtgatttttatggtgcctaacgtgatctcagcggctgcatgggccatgatctataaatttattttcaatgatgatatgggaattttaaataacctgatccgaaggttttccccggactttcatgtccaatggttttttcagtccccgtatgcattctgggcagttacatgtacatggatcttttatgcggtgattgtaactctggttgtattaaatgatttgatggcagtacctgaggaagtggtggaagctgcaagagtagacggggcctccccgtggcagctgacccggcatatcatgcttcccctttgcaggaatgccattggaacaggggtgatctgttccattacttccagaattgccatgtatgagcagatcaggctgaccaccgcaggcggccctggagacgataccatgaatataccgctgatcctggtcaattccatatccgatatgaaatacgggtatgccaatgccaacggtatgatcatgtttgccctgggtcttataattctggcagctgtcaatgttacattccgcatgaatgacagtatctattaggaggagggcgtaatgaagaaaaaaatcactgtattttgcatgtatctccttatgatctttactgtgatcatatcggtttttccaattctctgggtgatcatgtcatcctttaaaacgaatgcgcagattcttggaaatccatttacgctgccttccgctataagctttgaaccgtatatatacctgtttgagaaatacgattttctccggtatgcggccaattcctttttggtgtgcatctcctcaacgctcctgtctttgttgttctttgccatgggtgcttatgtgatcggaaaataccgtttcccgggaaagtccctgatttttgccttgtttaccattaccttattggtcccatcccattccaaggcacagcccatattctctctgatcatgaagatgaatctgtatgacaatatctggggactggcagttgtttacttatccatggggctggcaatgtccatgtttattttaaaatccacctttatgtccattccttcatccttagatgaggcggcaaggctggagggggcaggctttctccgggtatttttccagatcaaccttcccctggcaaaaggcggactggctacggccggaatcctcatgtttttaaataactggaatgaatttttctacgcttccctgctgacctcttccaataagaacaggactctgccggtagcactgcaatttttcaccgaatcattttcttatgattatacaaagctgtttgccgctttgacccttgtcgtgcttcctggcattattttgtatgcgctggcccaggagcaggtacaggcaagtgttgcagcatcaggagtaaaaggctgacaatttaggaggacagaatgcttaacacaatgaatttttttaagggccagggagatttgaaaaactggctgatagaggaaacagaatttgatgcccggaatctgggaaaatacgaggcaatttttgcccagggaaacggttacatagggatgcgcaatgctctggaggagcggtatgtggaagaggtgaggaatacctttattaccggaaccttcaataaagcaggagatgaggaggtaactgagcttcccaacattccggatgtaactgccatggacattactgttaacggataccgtctgaatctccagtcaggaaaggttgtggagtattccagggttatgaactttaaaaacggcgaaaccaccagaaagattgtatggaaatgcccggaagggacagtggtaacggccctatttaaacggtttgtttctctgaaaaatgaacatgtagcggcggaatacttagaactctcctgtgatagcagcgcccagctggtgattgaaacggggattcatggggatgtgacaaaccatggagccatgcatttcgagaatttgaggcgcagaatttatgatggagttactatgcagttcctttcggaaaccacccagtcccgggttctggcggcagtccacagtgcctgccggataaaccgggaggaaaagccccttcccattatgggaagaagaaatatggatctgcgctggtccatcacagcagaggccggagaacccatccgcctggaaaagatatcctgttttcattcctccagggatctggcttatgaaaaagaagaacactccggcatgtctgagcgtttgaaggccgacggaatggactgcttacggattgagtttgaaaaaggatatgatagactgctggcggaatctgaagcagtgtgggaagatttctggaaagaccatgaggtgaccatacggggaaatgatgattttgatcagcttgccctccgttttgcccagtaccatttgaatattatggtgaaaaaggacgataaccgggtgggaatcggtgcaaaggccctgacaggagaggggtataagggccattccttttgggatacggaaatgttcatcttaccctactttacccttacggagccaaaaactgcaagaacgcttctggaataccgctacagaaatctctatggcgcccgcaaaaaggctggtgaaaacggctgggagggagcgatgtatccatgggagtgcgcctggatcgacgacggcgaggtaaccccttatacctgggcaccgacgtggtaacgggaaaagtgcaaaagtgcctgacaggcttaattgagcaccatatcagcgcggatgtggcctatgcggtgtggcaatattatcaggcctccggagaccgaaactatatggagcggtacgggtacgagatcatactggatacagctcttttctgggccagccgtctggaatggaatgagaataagggctgttacgagatacttgatgtgatcggcccggatgagtataaagagcatgtggacaataatgcttataccaattatatggcggattataatatggagctggcagagcatattatggaagctttgccaaaggaaaataaggaagtttcagaccggcttgaccggaaattccgtttcagccagttaaaacaaaagcttatggaaaagagggcaaagttctatttgcccgcacccgatgaaaacggcattgttcctcagacagaccagtatatgagcctggaacccattgacctggcaccctataaggcgtcaggaagggtcctgggaatccaccaggattataatatggagcagatgggaaaactgatggtttccaaacaggctgatacggttatgctggattttttgctgcctgatctgttccctctggaaacaaaaagaaagaattttgaattttatgaagataagaccctccatgattcttccttaagccgctgcgttcatgcagttttagccaatgattacggaatggatgacatggcctaccaaatgcatcaggcggcatgctacactgatctgggacctaatatgaaatcctcagaggaaggaattcacagtgcctccatcggagggatctggttaagctgtgtcatgggctttggaggtgtgaggatccgccatgacagtctggagcttaatccaaagcttccaaaggcctgggaggagcttcgttttccattggtttggaagggtcagaaactgacggttacagtggaaaagaaaggcgtcagaatcgcaaacaacggaagctgtccggtaaagcttgtggtatttggaaggagcagcaaggtggaaccaaaagagtctgtctacgtggagaagaaaacttatgaagcagttatttttgatttggatggagtgatctgccataccgaccattaccactatcttgcttggaaaaaggtggcggatgagctgggaatttattttgacgaaatcatcaataaccgtctgagaggagtcagccgaaaggaaagctttgatattatactggaacgatatgatagggttatgaaggaagaagaaaaggaaacatatcttacgaaaaaaaatgagagttataaaaaactgctggaaggcatgaccccttccgatttgtctgttgaaacaaaagatacattaacggagcttagaaaacgggggatcaagctggccatcggctcttccagcaagaatgcgggactgatcttaaagcagttaggcttggaacacttctttgatgcagtttccgatggaaatgcaatcacccattcaaagcctcatccggaagtatttcaaaaagcagcctcaatgctgaactgcgaaccagaaaactgtcttgtggtagaagatgcggaggccgggctggcagcagcaaaatcctgcggaatggattgcgcggcagtggaagatggggtaaaatcttcattagcagagtataaactgtcatccttcaggcagttgctggaaatcgtggaatgaggaggagcggtgatggaagactacagcatggaactggatatccgctccgttccctttagcaggtacggctcttacctggcattttcctaccctcaggatggcacaaaggagtttgacggccacattgcggtgcgggtgctttacggcgctttttcccagcaggagacctaccccatcatacttttaaatgatgaaggaaagccggaagaaaagtttgctgtttccatgtcaccctgggaactgaacgcagcttctgaaacaggaggctactccatatgctttagggatgaggacacgtttctcttaaaagcggacagtcccatattgatcacaaagacaaaagcaggcacctatgacagagtgatggaacatatggatggaagctttgaaattgcaggagatgatatggcgctgcgcgtgtcaatacaaaagggaaaagcaaaggatcaatcggccagtcagggcaatggctttggaagcagcagaacagggcttcttctgagcccaaaggaaggggagctgttggcagcggtcactcttaccggtttaagcccgcaaaaagaggaatatgaaagctatgatgtttgccgtcaggcggtaaaagaggaatatgagaaatttgagtcaggaatcataaaaggccttaaaaagccggatcctgcttatggaaaagccggaagagaggctgcttatattttgtggcattccgtgctctatccgtccgggtacatcaaaaggccggtaatggtcatgacaaagaactggatgaatctggtatggagctgggattatgcctttaacggccttgccctggtttcctctcatccggacctggcatacggccagtttttggccatggcggaccaacaggatgagtatggggcatatcctgatgcttatcaggcgaggaagatcatacgctcttttgtgaagcctcctgttcagggatttattctggaaaaaatgtttcagatccatgatccgggcagggagatcaaggaaaggctgtatcattccaccgccgcctttaccaactggtggctgacctaccggatggaggaaaacggcattcctacctatcatcatggcaatgattccggctgggacaatgcaacggttttccgcttaggcctgccggtccagtcaccggatttatcggcctggcttgttttgcagatggagtttttagaacatacggcaagagagcttgggcggcattctgaggctgaaacatggaaggagaaaggggaagagcttctctctaagctgcaggcttattttgtcagaaataaccgctttattgcagtgaaaattccagagatgaaggcggtgccctctgattctctgattctgtaccttcctctgatccttggaaagcgcctgccaaagaaacttcgggaagatctcctttcagggctcttaaaggacggccgtctggccggtatctggggatttgcatcagagcctatgaacagtgagctgtttgaggaggacggatactggcggggagctgtctggccggctgctgtcatgattctgacagatgcgctgagacggtgcggcagacaaaaagaggcacggatttacgcagaacgtttctgcagacttttgcgcggaaaagggattttatgagaattacagtgcactggacgggagtggcctgcgggatcacggctttacctggacagccagcgtatttttcattttgcttcgtgattatatattgaattagaaagggaaaaactatgaaaaattggtggaaagaatccgtagtgtatcaaatttaccccagaagcttctgtgacagcaatggagacgggatcggtgatatagggggaatcatcagcaagctggattatttaaaggagctggggatcgatgtggtctggctgtctcctgtatatgattctcccaatgatgacaatggctacgatatccgtgattaccgtaaaattatgaaagaatttggaaccatggaagagtttgataagcttttaacggagcttcataataggggaatcagactggtcatggatcttgtggtaaaccacacctctgatgagcattcatggtttgcggaaagcagaaagtcaaaggacaatccttaccgtgattattacatatggagggatggaaaggatggaaaagagcccaataactggggatcctgcttttccgggcctgcatggaaatacgatgaggaaacaagccagtatttccttcatcttttttctgaaaagcagcctgacttaaactgggataatgagaaagtccggacagaggtatacgacatgatgaaatggtggctggataagggcattgacgggttccgcatggatgtgatcagcctgatttccaagcgggaaggacttcctgacggcccggccatgatcaatgggtatgccagctttaatgttgcagccaacggtcccttggtccacgaatatttacaggaaatgaaccgggaggttttatccggttacgatatcatgactgtgggagagtgctcaggggtcactcttgaggaagccgccaaatacgcatcttctgatggtaaggagcttaacatggtattccagttcgaacatatggatgtggatggggaccctgacaacaagtggacggataagaagatgcacctgccggatttaaaggcggtcatgacaaagtggcagaaagggcttgagggaattgcctggaacagtctgttctgggataatcacgaccagccaagagttgtttcccgctttggcagcgactgtgaggaatacagagaacgttcagccaagatgctcgccacctgccttcatatgatgcaggggactccttatgtatatcagggagaggagctaggcatgaccaatgttccatttgaaagcattgatgatttccgggatcttgacagcataaatgcatatcatgagctgaccggaaaggggatttttacggaagaagaaatgatgaagtatataaggtacaagagccgggacaatgccaggacgcctatgcagtgggatacaggcgcttatgccggattttcagaaagtgacccgtggatcatggtaaatcccaattataaaaccatcaatgccaaagaacagatgaaacgggagacttctgtattccattactataaaaaactgatcgctctccgccataagtatgagatcattgtttacggcagttatgagctgcttcttccggatgacccggatatatatgcctatgtgaggactttgggagacaggaagcttttggtggtatgcagcttcagcagtaagaccgtaaattactgcataccggaggaatttaagtcaggaacggttttgatcagcaattatgaggcaggggagaaaaagagcaaagagcttagaccttatgaagcgctggtgatttatcaatagttttatattatataaaacaaaaaggcttttgcaaaatgggtccgtatgaaaccattttgcaaaagccttaaatttatacaaaaatcccattcagcgggttattctgaatgggataaaattctgttctataaattaagccattgtgtttacagctttagagattctggatacttttctggaagcggtattcttatgatatacgccctttgtagcagccttatcgatctctgcgatagcgcttgctaaaattgcctgtgcagcagccttgtcaccggcaacaacagcagcctctaccttcttgatagatgttttcactttggatctgatcgctttgtttcttgcagcttttgtttcgtttactaaaattctctttttagcagatttaatgttagccaatcggtacacctccaataaaatgatatatgattattctttgttttgcatcaaagcctggacacggacagttcaatgtaaacatactttttcattctatcgaatttcgtcgcatatgtcaatacataattcccgtatttttgcagaaaataccttagaaatgctggaaagccatactggcataactttatgtcaaaaagcatgggcaattaacaggaaaggtggaaaaaatggaaaatacatttacagtgcgcacagatcttgcagtagaagagagagaaagcttcccaggcgacggcggtgaaatatcgggggtatccctgcgggagtggcaccgggcagacagccatataaagatgaccgaagtaaaaattcttgataaaaagggcgaaaaagccatgggaaaaccaattggaacttatatcaccctggaagccgatgagctttccatgaaagacgaagattatcacagggaggtttcggaagaactggcgagccagatcgaacgtctccttgcggggaaaaattacaggaagccggaatttcatgtgctggtggcagggcttggcaattcttccgtgaccccggattcccttggtcccagagtccttaaaaaccttcaggtgacaaggcatttgaaagtccagtacggggatgatttctggaaaggaagaagtatgcccacgatcagcggcattgttccgggggtcatggctcagacaggcatggaaagcgccgagattttaaaggggatcataaacgaaacagagcctgatctcattattgcaattgatgcgcttgcggccagaagcgtaaagcgccttgggactaccattcagcttacggacacagggatccacccaggttccggagtgggcaatcacagacacagccttaccttggaaagccttggcgtgccggtcatggccattggagttcccaccgttgtaggggctgcggccattgtccatgatacagtttctgccatgataggcgcactttcaaaaagcatggaaacaaagggaatgggagattttatgggaaagctgaactccgatgaacagtatgaccttattagggaattgctggagccggagttcggacctatgtatgtgacacctccggatattgatgaaacagtaaaggaattgagcttcaccatctcggaaggaattcacttggcatttttgggacaggaagtttcgtagtaaatggccgtcattctgcataggatattatgaataatttatgcaggaaggcggttatgaaacagagaaacaagggaattaactggtttataagaaaaatgatgattgcagtaagcctggttctggccgttcttctcagtataaaagaagtatcagaggccgggaaaaaggccgattttaataaagcggaaaattgggcaaaagaaggggccggtcttggggcttcctatatctggaggcaccagtatccggccgttgcttgggaagaggacggacagaacagcattttgtccggaacacgtgaaaaatccgttatcaatgtgatctgtgatttccttttcaaccagtctcctctataccggtatgcgggcagcagtaaaaaggcggaaacagattatggggatattgacccagcctatgagggatatttggaaagcgggagattttatgaggagcacagcgttctgttatatgacggcggagaggaaagcggagaagacggaagcatcaatgccggaaccagcaaagcgcagcccgaggggcagccggcaagcggaggatcggaacagaatcaggctgctgagaccaatcagccgacagctgaaaaaggaagtatccagacaacggataaggacccttccatgacctgtgcggtaagcaatgtatggcccatatcagggactttataccgcaaggaacagctggctgactatgactttctgatacagcatttttacagcgtccatacatccactacggttggcagggatttaatgaaggcagataaattcctttccgaggattttaccctggaagggggaaatgacaaacctcaggtccttatttaccatacccattcccaggaagaatttaaagatcacgggccggataatcccaatgccaccgtagtgggaatcggaagctatctcacggaacttttgacggcaaagggctataatgtgatccacgatacctcggtttatgatttacagaacggaaaactggacagaaacaaggcatatacttatgctcttgatggaattacaggcatccttcagaataatccttccattgaggtgatcctggatgtccacagggatggggtaaatgagaatctgcacatggtaaaccaggtcaatgggaaacccacagcgcccattatgtttttcaatggagtcagccagacaccaaaagggccgattgaatatcttcccaacccatacagggatcagaaccttgctttcagctttcagatgcagcttgacgcagcggcctattttccaaatctgacccggaaaatatacataaaaggacttcggtataacctgcatttaagagcaaggtcagccctgatcgaggtaggcgcccagaccaatacataccaggaagcgttaaacgctatggaacctctggcagaagttttagatatggtgctgcaaggaaattaaaaactgtaagaactatgtatatcccgccctatctggtataatgataacaggtgaacagaatattgacatagtaccccaggcaacaacctggaagccataataaggcgtgggaataggataatccggttatggattttcttgtttctgcgctttttttgtttgcatgattcagagagtgagcagtggaaggaatgttttccggaaacatagaaggggccggccaaaagaagggttacggctttttgattgacctgctcccactgtacacttgtcgaaatttgaccgataggtgttttcttttgatatacatattagtaagaatggcatatattgaattagaagtttatttagagaggagagtttttatgcccagctttgaaatcaaggtatgggggtttaaatacaaagagccgtatccctctagatgtacaagaagaatttgttatttaaagggttgtcgggaagtcgaagtgccctgcgggctaaaaggaacccaattttatgaagtgatggtcagttttactttcccggatcttgatgaaaaatatgaagcgatcatctttcagtgcgctaatgaagttacgtatcttgcaagcggcattgtgggtaatgctctcagttcttgcgtggaaattgatgaatcatgtatgaaagttgttcaagattcagttgctttggcaaatgaagtagtggaaaaagcatatcataagtgtttaagccagttgcgcatgcctgaagaaataattcgtaaaagcgaagttaaagtctatattagagaaaattatatgtaagtacgtacttatctgaaaagtatgtctgcacacagaggcggtcaaccccgtctctttctcattcggaaaataaatgaatgggacaagaccgcttaactagtagccttttctctgtatagtttatcaaagacataacagaatatagatatccatctttttgctgccaggaaagtaattgcagatggaaatgggatatgataccatagtgacagggacaatggtgtcactgcaagggcgttggccttccattattaaagtcccggtaatgagcccatccttgtaaactttgaagagtgaaaagggcggatttctatctttttattggcaaccccttgtattggggcggttgtttctttaatattaacctaacacagatttactgtatttgcatgtgaaggaaatgtcatttcagtaacactataatactaaaatgatactgctatttttagcaaggacagcaagacaggcggtcattcatatttttccaacggaattacagggaaattcaatgctttcacggtggacaatcagtcattttaatggtatatttttaaagatatcatagtaatctggcggattttgcccttttgacgggtgcttgccggagaacaccagaaacatcagaaaagaggaattaatcatatggcagctgcccagcagaataagatacgcaacttttgtattatcgctcatattgatcacggaaagtcaacccttgcggacaggattatagaaaagacagggttgttgaccagcagggaaatgcagtcccaggtgcttgataacatggatttggaacgagagaggggaatcaccatcaaggcccaggcggtccggaccgtttacaaggctcaaaatggcgaagaatacatctttaacatgatcgatacaccgggtcatgtggactttaactatgaggtttcccgaagccttgcagcctgcgacggagccatcctggtggtggatgcatcccaggggatcgaggcacagactcttgccaacgtttatatggctcttgatcacgatcttgacgtatttccggtattaaataaaattgatctcccaagcgcagagccggagcgtgtggtggaggagatcgaagatgtaatagggatagaggctcacaatgctcccaggatttccgcaaagacaggagaaaatgtggaagcagtcctggaagccatagttgaaaagatcccggctcctctgggagacccggaagctccccttcaggccctgattttcgactctctttatgattcctataaaggcgtcatcgttttcttccgggtaaaagaaggaacagtgagaaaaggcgataaggtgcgcatgatggctaccggagcaatagaagaggtggtggaggtaggttatttcggtgcaggacagtttcttccctgtgaattcttaagtgcaggcatggtaggatatctcacagccagcattaagaatgtaaaggatactgcggtgggtgataccatcacccatgcggaccgcccctgcaaggtgccccttccgggctataagaaggtgacttccatggtttactgcggcctatatcctgcggatggagcccgctacaatgatttgagggatgccttagaaaagctgcagcttaacgatgcttccctgttctttgaacctgagacttcccttgcccttggctttggtttccgctgcggatttttaggtctccttcatctggaagtcattcaggagcgtctggagcgggaatataacctggatctggtgacaacggctcccggcgttgtttaccgtgtgtataaaaagaacggggagaagctggaactgacaaacccctccaacctgcctgatccaacggaaattgaatatatggaagagccaatcgtcagcgcggagatcatggtgaccacggaatttgtaggcgccatcatgactttgtgccaggaacggcgcggtgtgtaccttggcatggaatacatggaagctaccagggcgctcttaaaatatgagcttcctttaaatgaaatcatttacgatttctttgatgccttaaagtcccgttccaggggatatgcgtcttttgactatgagctgaagggctaccagcggtcagagcttgtaaagctggacatcctggtgaacaaggaagaagtggatgccctttcctttattgtccatgcattatccgcctatgacaggggccggagaatgtgcgagaagcttaaggatgagattcccagacagcttttcgaaatccccatccaggcggccatcggaggcaagatcattgcccgtgagacggtgaaggccatgagaaaggacgttcttgccaagtgttatggcggtgatatttcccgtaagaaaaaacttcttgaaaagcagaaggaaggtaaaaaacgtatgcgccaggtcggtaacgtagagataccgcaaaaggcatttatgagcgtactgaaattagatgatgaataaaaagaatctggagatttatgtgcatatcccgttctgtgtacgtaaatgcgcttactgcgatttcctctcttttcccggaaatcagcagatgcagcgggaatatactgaaaagttaatagaagaaatcagatgccagagtgccaaagtcaaagaataccaggtgatcagtgtattcatagggggaggcactccttctatattaaatatggaggacatggcagcagtacttcaggctcttgccagtgggtttgagattctggctgatgcggagatcaccatggaggtaaatcccggcacggtcacggccgaatccctttcctgttacaggaaagccggggtaaaccggatcagcatgggccttcagtccgctgatgacaaagaactgagctacctgggcagaatccatacttttgatgaattcttaaaaagttatcagagggtccgtatggcaggatttgataatgtgaatgtggatctgatttcagcaattccaggacagaccctggaatcatggaagaataccttaaaaaaggtgaccatgctgaagccggagcatatatccgcctatagtctgatcgtggaagagggaaccccttattttgaacggtatggggaatgtgctgagaggaaaaatcattttctgtcacaagaaggcaattgccttaagtctttgccggatttgcctgacgaggatacagagcgtgaaatgtattacctgactcaggaatttttaactgagcaggggtatgaaagatatgaaatatccaattactctaaaaaaggcaacgagtgcaggcacaacatcggctattggacaggaacagagtatttaggcttaggccttggcgcatcctcctatataaacggatgccgttttcacaatacccctgtttacaaccagtattgcagcgcctcctttgaccaggaagaagcatttcagggagtgctcaggcaggagtttgagcggctgaccatagaggaaaaaatggaagaatacatgtttttgggactgcgcctgacgcaaggtgtctctgcccaggggtttgtcggcagctttggccacaatatcaggaatgtttacggtacggtgttaaatgccatggaaaaggagggccttatggagtataaaaatggttgttactgtctgacctccagagggaccgacatcagcaattatgtcatgagccagttcttaatataagcatataccccatacagtaatgatagctgttattcaatacaattaaccccaaattcagaacataaaacaagtaatttgatttcagttaaagtaaagtaaaaggcgaagataagaagaaaaatcttggattttatgtctgatattatcatactataacaagaatcatgtaattgaaatatgctatgaatatggacttttgtctgattgcatatgaggtgaagctttgttaaagacgatggcacggaaagcaaattgatttgatgagttttcttttcaataacagacagaaatcttcttgttcttttttacaagagggtttctgttttttgttcataactttccggaaatgtagaatatttttccccgaacttgggaacgattcgtatttaaaatatggtatagcataataggaggacaacatggataaggcctgtaaacgaaaagaaagaatcgttacggatacgctgatcgatgaatattgtacatggttgcatggatgtgaaaaaagcaaggaaacaatactgagataccggcatcatctttgcttattcatgaactatctcaatggaagatctgctaacaaagaaattgtaataatgtggaaaggtgcgttgcggggaaatatggctcctgtgactgttaatggggctttggctgctcttaatggcttttttaattattgcaattgggggattgtaaagtaaagttccttaaaatcagccgcaacactttttgttcagaaaacaaagagctgtcaaaggctgagtataagagattggtaaagactgctttggataaaggcaatgaacgaatggctttacttctgcaaacgatctgttcaaccggaattcgagtgtccgaattaccttatattacggttgaggctgctgtaaaaggaaaggcggaagtggattgtaaggggaaggtgagaacggtatttcttacaagacagttatctcagatgttaattagatatgcacagaaacagcatatcaaaagcggtatgatttttataacaaggaatggagctgcgctggacagaagcaatatctggagagatatgaaggcattgggatcagaggcgggagttgcacgggaaaaaatttatccccataatttgcgccacttatttgccaggtcttattatgattcagaaaaagatttatccaggcttgcggatatattgggacatagcagcgttaacacgacccgtatttatactatggaaagcggctataaccatataaggcagctggaaggtctccaattgctggttggcattgacgacagaattcctcttttgttgtaaaagcagaacagtatctttaaatattctactacataaaggaaataaaatccagtatttttctttcaaatctccctttttgaaaatttgcgcacaataaacaggctggtctgtataaatcttgtaaaaccagcttttttttcgtgtttatctttaaatttttacaaccagaatgtaaaatcagacccggcttttctttctcttatacaacaaaagaggaattctgttgtaatttgcaggcagatatcaatagatgcggcaagttttttttgtgtaaaggaaaatttgtctccaaatgtaactaaagagaaaggaaggtaataatgaggaatgaaaaagaggttatgtgtattgacagttcttgcgttttcaataggatttttaacatcttctttttacgaagatgccttagcggcggaaggctggaaaatcgaaaatggtgaatggtcatacctggattcggatgaccatcaggtgacaaatgcctggaaaaagtcaaaggatagctggtattacttatcatccgaagggacgattcttaagaactgtatattcagtcttggaagcaccagttattttgtggatgaagagggaaagatggttcaaaacacctggatccggatcgatgaatccaaggatccggaaggaaactttgaagaaggctggtactatttcggaacagacggcaaggcatatcagaggaagaataacagtttcaaaaagaagatcaacggaaatacctatatctttcacgaggacggtcggatgatgaccggctggtttgatgaaaatggaaattccgtcaatgattctgatgatccctttgtggaaggggcctattattctggagaagacggcattctgtatacagacaaatggctggattatggcgaaatcggcaatggagtcggcggttcagaactgctaagtgccattactgaccgctattattcagattatgaaaaaatgtggatttattttgacggaaactccaaaaaggtttacagcaaaggagagaatttacggcaaaggaacattggcggatatacttatggatttgacgaaaatggaattatgatcccatggtggagcaaagtggctaccatcagcaatgcggataaaagcaatcctaccagttccacctccgcaagatattattccgcatatgatggaggcaggcttttaaaaaatatgtggttctggatgtatccgtcggaagatctggatgaaacggattatgatgatcaggaatgcagctggtggcatacagatgaaagcggagaagtctaccggaaccggatccgtaatatcagcggaaagaattatgcttttgacggaatcggaaggatgaagaccggctttgtattgtttgacggaaaatcagagtttgtagcccagtacgatatggatgcctggagttcagaggactttataaacggctctttatatgggatcgaaaaatctgacctttatctgttttctcctgatgaattaaacgacggttccatgcagaccggaaaagaaatcaaagtggaactggaagacggggtctttacatttggattttccggaaacggaaaggcatatggtaacaggaaccagcttcagagaaaagatgaccggtattacatcaacggacttaagctggaagcagatgagggatatggctacggtgttgtagaggtccggaaaaatgatgaaacgtattaccaggtagttgatatcaacggaaagattgtaaagggtgataaaaaggcggtaaaggataaagacggggatatctccttatcataaatgacagattcgcagcctgggtgggagatgatgaaaaacccagatggagaaatggagctgatggaaccggtttctatcattatgacaagaataacaaggagaacccatatgaaggaggcatgattgccggctatgatacggagccttccacagatgaattgccttcagaagagagacttaatttttagcatgagtatttctagaaaataaaccatttattgcatatggaaaaacagtatcagaactgtttgttttccatagaaatactaattgcgaggaggaaagtcagagtgggaataaaaacaagaatcaagcgaataatagctgggctgctggccttctgtattgtgcttggcgggatccccgttacaggcgggatcactgcatatgccttgccggagattgataattctcaaattgccaatggacataatgataatacaatatgggcaagtttaagcaacggagccagatttgatttggtcggcattaaaaaaagcggtgtatatgattatcaaacaagtaacagccaggttttacaaacggtttttagttttggaggatatcacacctacatgaatgattctgcgctgaatagcggccaaatcacctatgtgcctaattccggtgcatacaatggaggtgtcatggaatttgcttccaaccatgcaaagtttcccaatatggaagtgtcggtgaaaaccaataccagcccggatggacagtatgtttttgtggattactatatttacaataaaaatactacctcaaagaccatgtatattgggactaccgcagatgttcagataggtgatgatgatggtgcaaatctcagcagaacctttgggacaagagaaggcttttacatggtgaatggaaagtccggggctgatgcaatggccacgtttgaatgcattaccaatgatcctgccttaaggatctatggggaagagtgggggtaaagcgatggatcggcgcatatagttcaggttacaattgtaatcatttgattacagcaccggatgaatttgaatctacttacccagcaaaccaaggttatcagtattatacatttaaagagaataagaatgattttaattcaagtaatgacattaagacaaatgcaatgggaaatgcaagtgcatacctggattcagcatttgcctactcatggaaagtagaggtccgtccatacgagattgctcgcagacgggtggcatacacagtcaggccgacatcttattatgtttcatcagacagaggagctgacagtacctcccgggatggttcatatcttaatccatttgcaacaattgattatgcaatgtcaaagctgaatggtaagaggggatacatttatattatggactatgatcctattaatggatcaataaatgttccctctggagctggaacagatattacaattttaagcagtaattttgatgaaaatggtgaaacaatctcagacattgtggaactggagcgtggaaccaaccccaccggccccatgtttcatgtcagttcaaataacagtaaattaagagtcaatcatatcaccataaatggcaatggtgttgtaagcaattatccattagtgaaagcgagtgcaggggaactctatattaatgcagaaactacttttacgggcaataagataacaaatcccgcatcaggcagtgcattggatgtaacaggaagtgccagcctgattataaactcaggtacggtttccaacaacatttcaaatggttcaggtgctgttaatttcaatagtaccggagaaatctcagtattaaatgatatccatattacagataatacaaatacggcaggagaaaaggcaaatgtctttttgtctgcaggaaagtacattactgtagagggagaccttggcacttcccggatcggtgtgacttcagaacagattccagaggcttctgtgggagagtcaacgactgccgggcaggaagttgttatagccgttccttcggctgattattccggaagtctttcctcctgtccgttcgcagataactttttggcggacgcagatagcggaaacggggcagggatttatgccaccattggctcctcctccttaagcaattcccggaatacggtcttaaagcgcaatggatatgccgtaagctttgcttaccgggattcctcttcgggaggaaccgtgacaggtgcgccggatacccccagcctgtcccttgcatcgggcgatggagtggttattccgccgccgtcagctatttccgggtatgaactgtccggaatcatcattgaacaggggaccggcagtaccttgactgcggtggaaacagcaggggatacctttggaaagataaccggtaccatgccggggcaggatgtaatggttacctatgagtacaccaggatcaatgcctccatcgcctttgtcgtcaacggaggaacgccccagccggaaatcctgaccggaacagccggaaacagcgtaaatgctctccttcccaacgtaaccagatatggatatgtatttaagggctggagcaaggtaaacagccagtccggtccggaatacatttcatctcttccggccgtttatccggaagatccggttacctactacgccatatgggaatcagatcctaatgtgaagtttgattacacggtggattacaccaaccagaacggttccatcgtgttccagacaacgaccacggaaaatacttattccgtggaggcggagatccagtcccagaaaaagaacattcatgggtatctgtggagtcttctggattcccataccagtccggttgaatacaattatgacgggctgggggcggtgcccataggaaactttaacggcgccacaggtcaatttaccggaaaaatgccgggacaggatgccgcggtgaaatacgcatacaaggtagaccgaaataacccggatgccagatccagtttaacagtgcgctatgtgacggagaacggaaccgtgattcatgagcctggcgtaacgccctattacccggaagatgccataagtacagctcctttggacctctatggataccagtttgtgtcgggacgcataacagccggagatactccggatgacgcagatggaaatctggtcagtgctgttcagggaagctttggaaacaacggaagttttacgggagttatgcccaaccagccggtggagattacatatatatatgaagcaacagaagaaggatatgcctttgccgtgaacttcctggacaatggtaccagcgacagcagtttaaaaaatatcattaatccggaagttcagcagaaaacagcggatacagcggtcagtgcagagttccgggagttatacggatacacctatgaaagtgctgcggcagttcctgcttccggcggaagctttgacggaacccatgactttacgggaatcatgccaaacgatgacctgaccgtcagctaccggtatgaccgtgttccgtcccagtggacccggatcattttcaaatcaggcattaatggtgctatttcccacggaagcggagtttcttctgatgtacaggaacaggggaacggaaccggagtctatgaggcttccgtattgaaaaatgacggcactacagcaggccagacagacagctatacctggagcaccataaaagaaaaacgcctggtgccactggctcaggctgaccagtactaccggtttgccggttggtttattgaccagaacggaaacggatccttagatgcgggagaacagcttctggaagaggatcaccgctttaccggagatgagaccgttacggccctgtttgaagaagatccggaaaagtggatcaacattcagtttgcggcaggagaacacggttccctggcagacggaagtatttcctcccttcatatccagtatgacaggacctggggagatatcgcaggccagatcccaggctatgtgccggaggtcaactatctggtggatggctggtatgacggggatacggaagtggaatcaacagatggattaaagaacggacacacctataccatacgcttctatccggatccggcagtattcggaacggatgtggcagctcccgatgcctctggcggacttaacggagaaggaaagggaaagattacggtttaccacaccacggcaggctatcagtatgtcattacggatctaagcggaaaaatcgtgggagtgcagacaggaaccattgcaggccgggtgtattttgacggactttatccgggagccagataccttgtgtacgaggcagcaggaactgtgaatgcagtcgtaggaaaccagatcggagaaacagcaggaaacatcagtgatccggtggaggtgctgactccggtggtggagaccaactaccagatcttgtatgatgagaaccacgaaggaaagacggtgctggtgatcaagcctgccgataagaagtcggattacgcagtcttaagtaaagaaggaaccgtgatccttactcaggaaaccggaagtgacggatggcagacagtgacaggaaatccgggaagcgtgactttttccgggctgaactacaacgaggagtatatcgtagtagccagaccaaaaggagagacagggattacggcagaaagcaggctgccagacggatcggcaattaccacagatccgggcggtgctctggaaatccccaactatatcgtggagactctggaaggccgtgtggtgagtgttgatcaggaagagatcgatgcagccagatatgaagaagcccataagggagacaaggtaaagatcacagcagacgcgtccaagggagccggggagaccttcctttattggaagattaccataggatcggttccgggacttaccggaaagctttatgagagagagctggcctttgacatgccggataccaacctggtgtttaccgcgtactattccaggccggttgccagtccgagcattgcaacggtagtggatgaggtccggggtggaagcggaaatgacatcgcccttgatccgggggagataccggatttagaagaagagctgaccactgatgcagaccggatcctgatggatcagaaccatgcggatgtgacctataaggtggtatatacaaagaatgccgcaaaggcaacggaatccaatgcagtgaaggcatcgccagaatacaacagcgatcacagccaggcgtttaaggctgcttggggactgaatgtagatatcgaaagatatgtcaacggaagaaagacggccatggccacgccatcggatgcagaattcgtcacctatgtccagctgaataaggatgatgtggacatgatggattaccagctgtaccggatcactacggacccggatgacggatcagcccaggcggaactggtagaactgtcagaggacccggaagagaccggcggcttattcacctttactgcccaggcaggaacccgttatgtgctggtgtattccaaggcataccggctgtatttcctaaaccggatagccattcctaagtaccagtattatttcaaggtaagaaagggagaagcccccagtgacgggtattatagctttgaatacgggcaggtagaagaaccggaagaccttttcatcagtgaagagggagtggaatataactatataggctggagttaccgtgaggaccgtctgaatgaattcgatccggaccgtgagatcagcaggaaaacctacgtctatgcctattaccaggacaatcagaaagaagtggaccatgccaggaaagagctggaggatgccataaaggctgccatagataagagcgatgactatttcctcacattaaaggaaaccggtaagttaaaggaagccattgaagaggccctggaggtactggagcggacatctccgaaggcaacgctggatgagctgttagaggccctggaaaagcttcaggaagtcacaaagcctttggatgaagtattggaggaccgctatgaccactatgacaagatccagggctccggaagcaaaggaggaagcaagggcggaggaggaagcggaagcggaatcaaagccagcccatacaatccgtcaaggagcaggagctataccgtaggaaccaatggaaactgggaagaactgtccggaaccggaaggcagtgggtctttgtgttaaacggagggatccgtctgacgggaatgtgggcaaagctggattatgcaagcggagacgtaagcaagaacggctggtatcatttcaatgccaacgggatcatggattacggctggttccgtgacgaaaagctggactggtattactgcaatacagaagctgacggatggtttggaaagatgaagacaggctggcactatgacaaggaagacagccgctggtattatttagacccggaaaccggaatgatggcaaagggctggaggaacatcaacggaaagtggtattactttacagagcagaacagtatggaaacctatcattacgatccggcaacggagaaatggatctataaaaacaatgaagggagaccgctgggctccatgtacatcagcgaaatgacgccggacggatacagcgtcggcggagatggagcatggctgcactaaggaggagactatgaaaaacaggaagaaatggaaagcacagactgctttgatactggcagccgccatggttattaccatggcggcaccgcccgcgtcaatggcagcattgaattacggcgatccttcgatcattcaatttgatcctcagagggggccgaatctgtcacattccacatatgcgaatgtgccaagatacgaaaacggaatttcatacgcaaccgggcaggcagggtatgccctgacgtctgcacccgtttttagtggaattgaaacagaagacagaggatccgggccaaggcccaagctgccggtatttcaggttgagtggccgggctatacctttgacggctggtacaatgaagacgggaataaggttcttaatttgccttacgcatttccctatttgtcaccggaaacctataaagcggtgtggaatggaaacagcagcagtcagtttaattttactgtcatgcattaccgcgatctaaatgcggcaagagacagtatgacggatggcagcaatcagtctgcctggccatcagccggcgacagccaggcgatccgattttttgacgacggaacctgggtccatccggtaacggccaatacaccggtttcagccacatataaaaggaatataccggggtataaattaaaatcagtgctgattaaaaataacaaaatcagaagatttgatgatgagagcggggcaggaaccctggatgaagcggcaactgtcaacacttctaccaatgcgatccggggatatatgcccaatgacgatcttacggttgcttaccgctatgagccggataccagcaagaaattcacgctgcgtgtggaatatgtggacgtagacggcacagcaataaaaacaccggatgcttatgcttactctgcagaaacttcattttcagtttctccggaaagcatcacggcatatgaacttattgatgcagaagtaaagtcaggatacggtgatacggatgatttaagcggcagaggtatttattctgcagctaccgccggctgcggatttgatgaggttaaggattatacagggaagatgcccaatcagatggtgatcattacttataagtatcagttagatccggattacacgactcatatcatcgtaaatacggtggacaatcacaataacattctttcagagcctcagaatctgtccgtttcaccggctgatcctgttgagctgacggtagaaagaaaatcaggatactcgtatccgcccaacatcacatggaatggcaatttcacgaatctcgctctggatcagacggaagaaaagctgacctttcagaccgatgttcttggaggcgccgttaccattacttataacgaagacttgacagatcccgattattgggcccgaattgattattataacagtgccaatggaactctgtccggagacacatctcccaagtccttccgcttgaatacctattcaattgacgagctgactcagaatatcaccccgtcaccggcatctcactacatatttgacggttggtataaggccaatttaagtggaaccggaaagaccggagcaaggcttaccggtgatgtggagttaaatgagaacttaaagttaattgcaaattttgaagaggatcctaatgaatggtttgatctggtctttgtatccggaagccatgggagcatttcaggaaccgccacagcccatgtggctaaggagacggcctggaccgatcttgtgcttcctgaaacccatgcggacaacaactatctttttgccggttggtatgatgaaaatggaaaccaggtacaaaacagccttcagattctttcagatcaaagatatacggccagatttacgccaattgcaggagacgacggaatattaagtattcctgatgctgccggaaccgtagcagcgaatggaaccggacaaatccagataaatggtgcaaatgaagagcggaagtatgtagttacggataccgagggcgttgtgatatctgttatgacaggttcccagctgcaaaacgggaaatttacaggactgggtccttgtacctattattatatttatgaactttcattaaccgcagctcccgttgccggtgacctgctgaccgatcatgtggatggatccctgacaagccagcctgcaagagtgggcattgttacacttggcagcaactattccattgcaaatgacggaaatgaaggcaggaaaaaaattaccatcagtcctgcggcaggggatacgctttatgcgcttcttgatggcgatgagaatgtggttttacccgccggatcatcagacggctggctgacagcttcaggaagtccgtctgcagtcgtattcccggatctggaatcaggacgggaatacacggtagttgcaaagcatttgggagagacagaagctccatctgagaaattattgctgggaaatcggatccttttagaagaatcaacccagacagataacaggacttatactctgtatatcactaacggaggctatgcagcggaagtcatcagagatggtgcagccctggagatcgaagagggagcgacccaaataagcgtccgcaaaggagataaaattaggataaaagctccggatataaccggatacaactttgtaaagtgggagtgcctgcttggttctatgtctatttttgcagcccagcagaatcaacaggttaccatgccggccggtgatgtagttcttcaggctcggtatgagtccatgaccgtagccactgcctccaatgcaaccgtggattattcacctaaaaatggagcctttgctcttaataaacaaacagatctgttggaagctttaaagctggatctgattgataacacctccgatccgaatttactggtatcaggacatgaggtggaatatacggtcaaatttgaccggagaagtacgccgactgccacggtgtccaatgcagtgagagcagctgcatcagtggacagtgaggcattaaagatcccctgggttttagatatatcattatcacgaaaggtggatggcattaataagaacctgccctccgatggaaaccacacgcctgatatacaggtttatggaatcctggatgccggcattctgggccatatggattatcagttgtggaaggttgaaaatggggatgacgatccggcatgcacggagattatccccctgggacctgatttaaatgatccggatgccggttttaccggtacgttcctgtttgatgcaaatgtgggagacacgattctattgacctattccaaatcctataaggttaccattgccgatacaaaacggggaacagtagcaagtcttaaggtaagagccggtagtgctcttgaagatgcggacggttatatggatcttgaatgcctggaagactatacggatccggttaccggcatcgtatatgaatttgcaggattgggaaaacaggcaggagcttccgctacgtatgatgtcacggctccggttaacaaagatctccagctttatgcagtgtatgaacaggaagatgattccttgtggcaggcagcaaaaaaacagctggaggatgagatcgatattgccaatgctttgaaaaacaatggcacggtaagtgaggaagacaggaacttactggctgatgcgatccaggatgcaatcaccgtgcgggataccctgccccgtcctacgattgaacagctgaatgatgcttatcaaacattaaaggatattgttgacggaatcagaaacggaagtggctctggaggagaaaacggctccggaggagaaaacggttccggaggaggcaatggttccggcggcgggaatggctctggaggaggaagtggttccggcggcggaagcggttccggtggcggaagcagctccggcagaggaagcagttccggaagcagcggccttggaccaggggcttaccgctttggaagctataaaacttatacaaatgatgtggatggctactgggataattttgacgccgcgaataatggctggtcctttgttttaagcagcggaacgaaactaaaaggccagtgggcgaatatccgctactctcataacggaacaacgctgatttatacataccattttgatatggaaggaacaatggacagcggctggtttctggatgaagaaggaaaatggtatttcatgtccacgattcacgacggctggtttggccgccttaaaaccggctggcatcttgatgaaaatgacggaagatggtactacctaaatctgtttaacggtgccatgcttaccggctggcagaaaatagacggtgaatggtattatctggcaccggaaaacagcaggcagacatggcatctggatcagaaaaccggaaagtggttttttgcagacaaatcagaacggccattgggctccatgtaccggaatgaagtgacaccggatggatattatgtggaggacagcggggaatggataccggagaccccgtagcctaaattgaaataattcttatagaaagggaaagtgtttgaattttgcactctccctttcttaaaaggactacatataaaagttgatacgaaataagcttatcaccatgcaggagagattgctgtaagaataaagaaaaatgagtgatgagatcatttttccttgtatgaaatcctttattttgaattattgaatagtcataacagatttttatggtaggagatttaaaagtacaaataaaatcaggattttgttgaaaaaagattttatggttaggagggaagcaattgaagtttatacataggctgaaacggattgtagcaagagtgttggcttttgcaatgttactgaatacgctatccatatcaggaattactgcttatgccgatactgagctgaatcctgatacaagtatgaaaaataacggaggtggtttaaactctgcttattattggggtaggaacgatccaaatggacaagtgtcttatgatcgatggtatgggtttaatattcagggaattcttgatccggagcggattggggcagagcatccatatatcaatctggatcctggaaaataccagaataacaatactggaggtatccaattacaacctcatgatgcagttcctgttacatgggactattctggttttaaaacagtaatcaggtctggaagtgaaaacgataccatcgcctatccaataacaattgagaataatggcggtgtacaaaagattactgaccgtggttataatgtggaagtgcagatgaaggtatatcccagtgctgaccgaaaatggaccatggtagagtatgttatgtacaataatgaaaatattcctaaaaccatgtacatggcgactggtgcggatatcatggtaggagatggaatcggatattccggggggccttctgacccggctgatgcatctaccctttatcttgatgaccagggattccatatggtaaatgaagccaccaagcaaacctttgatgttgttacaaatggtgacagcgaggtgggaagggaattgggggtaacaacagtagattccagatgggccggaagtgactatatggtattttctaattcgataaccaacaacagtagcagttaccataatgccaggtattatgctaacttatctgatgagccgacaaatgcgaatcataagaccgatggaacagtccattggattgaaaacatggacacaaaaatgtcttattcatggaagcttgatttgggtccttatcagaaggtggttagaaaagttgcctttaaagcgcaggaacaaacttattatgtctcgtccgttcatggagacgacgtaactggaacaggtgaatatgataaaccgtttaatacaatagaaagagcaaaacaggccattggtacaaagaaaggatatatctatattcaggattacgctccggttaaccaaaccattgtaattggtgaaagtgggggaagccctgatattacaattaaaactgcagatgttgaccatcagcggaaccgcataacaacgccggttgcattaaaaaaagactgtgacggaccactgattgaaatggatcagtcaggaacaggttctattctccgccttgatgggattaacttaagcggagaaaatgtttccgacaaaaatgatccgctgattctggctgaccggggaaccatccaattaaataaggatgctgttctggagaaaaatattgtgaccagcagtgatcctgattcggctgtgggcagtgcagtacatattaccaacagcgcaaatcttatattagatggtgcggaggttaggatgaaccagtctgccttacggggagcgatttattttaacagcacaggaaagtttcaggttttaaatgaagttaccattaaagataatgtaaatgcagaaggcaaaaaagcaaatgtttatctggctgacgggaagtatattaccgtagacggagatcttggttcgtcccggatcggtatcacttcggagcagattccagaggcttccgtgggagagacaacaatttcgggacaggaagttgttatagctgtaccttcggctgattattccggaagcttttcctcctgcccgtttgcagacaacttttttgcggatgcagatagcggaaacggggtcgggatatatgctaccgtcggatcctccgccttaaataattcccggaatacggtcttaaagcgcaatggatatgccgtaagctttgcttaccgggattcctctacaggaggaaccgtaaccagtgcgccggatatccccagcctgtctttcgcatcgggtgatgaggtagtaatcccaccgccgtcaggtatttccgggtatgaactgacgggaatttccattgatcagggaacaggcagtaccttgactgcagtggaaacagcaggggatacctttggaaaaataaccggtaccatgccgggacaggatgtggtagtcacctatgaatatacccggcttgaggcctccattgcttttgtggtcaacggagggacgcctcagcctgaaacactgaccggaacagccggaaacagcgtaaacgccctccttcccagcgtaaccaggtatggatacgtgtttaagggctggagcaaggtgaataatcaggccagcccggaatacatttcatccctaccggctgtctatcaggcagatccggttacctactatgccatatgggaatcagatccgaatgtgaagtttgattacacggtggattacaccaaccagaacggttccatcgtgttccagacaacgaccgcggaaagtgcttattccgtggaggcggagatccagtcccagaaaaagagcattcatggatatctgtggagtctcctggattcccttaccagtccggttgaatataattatgacgggctgggggcagcgcccataggaaactttgacggctctacaggacaatttacaggaaggatgccgggacaggatgcggcggtgaaatacgcatacaaggtagaccggaacaatccgtcagccagatccgatttaacggtgcggtatgtgacggagaacggaaccgtgatccatgatcctgccgcaaccgcttattacccggaggatgctataaatacagctcctttggacctctatggataccagtttgtgtcgggaagcataacagccggagatactccggatgacgcagatggaaatctggtcagtgccgttcagggaagctttggaaacaacggcagttttacgggagttatgcccaaccagccggtggagattacatatatatatgaagcaacaggcgaagggtatcggtttacggtcagttatctggataataacacccttgataataacttaaggaatatcattaatccggagatacagcagaaaacagcggatacggcggtcagtgcagagttccgggaattatacggatacacctatgaaagtgctgcggcagtaccgctttccggcggaagctttgacggaacccatgattttacggggatcatgccaaacgatgacctgaccgtcagctaccggtatgaccgtgttccgtcccagtggacccggatcattttcaaatcaggcattaatggtgctatttcccacggaagcggagtttcttctgatgtacaggaacaggggaacggaaccggagtctatgaggcttccgtattgaaaaatgacggcactacagcaggccagacagacagctatacctggagcaccataaaagaaaaacgcctggtgccactggctcaggctgaccagtactaccggtttgccggttggtttattgaccagaacggaaacggatccttagatgcgggagaacagcttctggaagaggatcaccgctttaccggagatgagaccgttacggccctgtttgaagaagatccggaaaagtggatcaacattcagtttgcggcaggagaacacggttccctggcagacggaagtatttcctcccttcatatccagtatgacaggacctggggagatatcgcaggccagatcccaggctatgtgccggaggtcaactatctggtggatggctggtatgacggggatacggaagtggaatcaacagatggattaaagaacggacacacctataccatacgcttctatccggatccggcagtattcggaacggatgtggcagctcccgatgcctctggcggacttaacggagaaggaaagggaaagattacggtttaccacaccacggcaggctatcagtatgtcattacggatctaagcggaaaaatcgtgggagtgcagacaggaaccattgcaggccgggtgtattttgacggactttatccgggagccagataccttgtgtacgaggcagcaggaactgtgaatgcagtcgtaggaaaccagatcggagaaacagcaggaaacatcagtgatccggtggaggtgctgactccggtggtggagaccaactaccagatcttgtatgatgagaaccacgaaggaaagacggtgctggtgatcaagcctgccgataagaagtcggattacgcagtcttaagtaaagaaggaaccgtgatccttactcaggaaaccggaagtgacggatggcagacagtgacaggaaatccgggaagcgtgactttttccgggctgaactacaacgaggagtatatcgtagtagccagaccaaaaggagagacagggattacggcagaaagcaggctgccagacggatcggcaattaccacagatccgggcggtgctctggaaatccccaactatatcgtggagactctggaaggccgtgtggtgagtgttgatcaggaagagatcgatgcagccagatatgaagaagcccataagggagacaaggtaaagatcacagcagacgcgtccaagggagccggggagaccttcctttattggaagattaccataggatcggttccgggacttaccggaaagctgtatgagagagagctggcctttgacatgccggataccaatctggtgtttaccgcgtactattccaggccggttgccagtccgagcaatgcaacggtagtggatgaggtccggggtggaagcggaaatgacatcgcccttgatccgggggagataccggatttagaagaagagctgaccactgatgcagaccggatcctgatggatcagaaccatgcggatgtgacctataaggtggtatatacaaagaatgccgcaaaggcaacggaatccaatgcagtgaaggcatcaccagaatacaacagcgatcacagccaggcgtttaaggcggcctggggactgaatgtagatatcgagagatacgtcaacggaagaaagacggccatggccacaccatcggatgcagagtttactacctttatccagttgggtaaggatgatgtggacatgatggactatcagctgtaccggattttacggatccggatgatgggtcagtccagacagagcttgtggagatgtcggatgatccggaagagaccggagggttgtttacctttaccgcccaggcgggaatgaggtatgtgatggtgtattccaaggcataccggctgtatttcttaaaccagatagccattcctaagtaccagtactatttcaaggtaagaaagggagaagcccccagtgacgggtattatagctttgaatacgggcaggtagaagaaccggaagaccttttcatcagtgaagagggagtggaatataactatgtaggctggagttaccgtgaggaccgtctgaatgaattcgatccggaccgtgagatcagcaggaaaacctacgtctatgcctattaccaggacaatcagaaggaagtggaccatgccaggaaagagctggaggatgccataaaggctgccatagataagagcgatgactatttcctcacattaaaggaaaccggtaagttaaaggaagccattgaagaggccctggaggtactggagcggacatctccgaaggcaacgctggatgagctgttagaggccctggaaaagcttcaggaagtcacaaagcctttggatgaagcattggaggaccgctatgaccactatgacaagatccagggctccggaagcaaaggaggaagcaagggcggaggaggaagcggaagcggaatcaaagccagcccatacaatccgtcaaggagcaggagctataccgttggaaccaatggaaactgggaagaactgtccggaaccggaaggcagtgggcctttgtgttaaacggagggatccgtctgacgggaatgtgggcaaagctggattatgcaagcggagacgtaagcaagaacggctggtatcatttcaatgccaacgggatcatggattacggctggttccgtgacgaaaagctggactggtattactgcaatacagaagctgacggatggtttggaaagatgaagacaggctggcactatgacaaggaagacagccgctggtattatttagacccggaaaccggaatgatggcaaagggctggagaaacatcaacggaaagtggtattactttacagagcagaacagtatggaaacctatcattacgatccggcaacggagaaatggatctataaaaacaacgaagggagaccgctgggctccatgtacatcagcgaaatgacgccggacggatacagcgtcggcggagatggcgcctggctgcagtaaggaggaaacttaaaaaccggcctaatcccattaactcctctcataaggctcctctggaatcaggacataggtgaaaaataaatagaaataatttattgaaagggaaagtattcggatcctgtgctttccctttccgcaaaaaagatctgataaagcatgatagataaagaggataaaaacatatgataaaaaacgaagaaatgcagaacgtgtgccacggcatgattgcaacggaccgggtcagcaccatgcttgtttgttttcacggaaaaaaagaaggagatttatatggtgaaattcttaacagttacatagacaggcctgtctggttttccggtgtaggcgatttaattcttaaattagatgaaatatgtgactggatcggaacgccccatccatccacggaaccaaggtttcttacaaaaaagatgtcggaggaatatgcatacagaaataaaaggacaaacactataccggttaaggcaaagattcagctgcaggacagcaaaaccttaagctcccgggctattctggcaaaagaaacgctgatcattaaaatagagcatcgtcagaatgccagcatgcaggggagagtgataggaaagcttacatcaaaagagtatgtgggatttcgaagcgcattagaattgatgcgcatgattaaagaagttgccgtaagaacggaaagatgcggaaacggaatgaagagttccgtataaataaaagcctggtgaaaggtaaaatcttcaccgggcttttatactgggatcctgcgttattgaaccagatatgcttccacgctcctggtgccataggagcgggtctccccatgggtgttgaagaaaatatcaatgtggtttcccttgactccgcctccgcagtcctccgccgtatagatgactccgttgaccatgatgcggcttccgtagggaatgactcttgggtcaacagaaatggtatggtttgcagtggcaatggttcctgtgctggtacgtccgccccaccctccggagcatttgcggcaggggcagtaagctgtggttttaaatactcccagagaacggaggttagaaccgctgttttggaggtttgcggcagcgagatcgcccacagggtggactttagtgccagacagcttctgaccgccggaataggcttctaccaggtaggtgccgtctccgtaagaactccatggaaccggtatctcaaaaccataatttccggtcccgtgggatactaaatcctcccggtatttggaggcagcggcagtaagctccgccacaacctgcccgtttgcctgattggtaataacaacttttacttctgcagcagtattgggatcagagttgttaagggcccagcctctgacgctgctttcgtcggcgttgtcaatgatgccagcggtctgcgctgcaaaaatgagaaatgtatttatcagaaaaaatgtcatcattagtaaggctcccaggaaccagtgaattcggtttgttttatgcatattacaaatacttcctttcttttttacaaactgtaatataatttaatatatttataattatatgtaacagttttgtaataaatgaggtacaagtaatcattttacacatttttccaaatttgtcaagaataaacactaaaaaatctctctgtgcttcttttcttagttgcctcggcatttgtttaatgaatatacaagcatatttgtccggctcattgtttgcgcaaaaaaaacaccgcagaacagcgatgtggttcgctgttctgcggcgtaatggggacatttttactgttcaatgactgcaaataattcttttgtctgtcttccaaaatccagggcttctgcgcggcttgcgaagaaaatatctactttatttcccttcacactgcttccgatatcctcaacggtatagacgataccgtcgatcataaccttggttccgagaggaaggatggtgatatctgcggatatggtatgctgcggcttgggaaccgtaccggaataggtcaggccctgcttgccggtgttttcgctgttagggcagtatgcagtggcggtgaagaacccaagagattctcctttttcataaacgggcgccgccggctcctccggttttaccggttcctttttcttgataccaggtccgatttcctcaggaagtgtctccgtattggctgctgctgtctgattttcggtaccggtttgtatggtttggtgatctgttccagagctttcggactgtacttgattcacagtttggtcttttcccgtagtttcggctgccagtgcagacatagataacagcagaatacaaagaagtgtcaggaatccggtaatacatttcttccctgaaaaacttttcataattttacctcgcaatgagcagtgcggattggaacaagaacaaatttttcgtcgtgcccgcacgtaagaaaatttgttcttgttccaattcatagggcgaatgcccgtaagcctgtggagccgtaggattcacaggcaacactgcggactagatcgtgttgctatgatcgtgttgttatggtgtcttccttaccattatattacaaaagtgttaaatgtcaagaaaaagttgtcaacagctttgtaatatttaataaaagaatgaggaaaaatgtacaaacaagccacaaaaacttcaccaaaaatttttataggaatgtattgacaaaagtagaaaaaaagaatatattatgaaaagaagatgttagcactcccaaacgttgagtgctaacaaaaaactcagaaaggaagtggagcagcttgagtgataaggatcagttagatgagcggaaggtaaccatattaaaagccatcatcaagacttatctggaaacaggagaaccggtcggttcccgtaccatatcaaagtatacggatttgaacttgagttccgctaccatccggaatgagatgtctgatctggaggagctggggtacattatgcagcctcacacctcggcaggaaggattccttccgacagaggataccgcttttatgtggaccagatcatgcaggaaaaagaagaggaagtcactgagatcaaggatatgatgctgaaacgggtagacagggtggagctgttgttaaagcagatggcaaagcttcttgcccagaacaccaattacgcggcaatgatcagcgctccccagtaccacaggaacaaactgaagtttatccagctttccaaggttgatgaagaaaagcttcttgtagtaatcgtggtggagggaaacatcattaagaataccataattcccattcatacggaattaaatgacgaaggacttctgaatctgaatattcttcttaacaatgcccttaacgggctgaccatagaagagatcaatcttgaagtgatcagcaggctgaaaattcaggcagggccccactgtgatgtggtggaccgggtactgaccgaggtggcaggagccatccagggcgatgatgaagaccttcagatttacaccagcggggccaccaatattttcaagtatccggagttaagtgatggagaaagggccagtaagcttatcggcacgctggaacaaaaggagcttttgcaggggctgatcgatgatgtgaacagctcggagagcggatccggaatccaggtatacatcggtgatgaagcacccgttaagaccatgaaggactgcagcattgtaactgccaactatgagctgggcgaaggcttaaggggtaccattggaatcataggaccgaaacgcatggattatgaaaaggtactcagcacattgcgcaatctcatgacgcagctggatgccattttgaaaaaagatgaaaggtaaagggaagagcattgagcatggaagatgtgaaaacagatgaaagactggcagatgagactgttcaggcggaagatgccgctttcactgaaaaagaaatagaaggcacagaagcctgtgcagacgacggaatccaggaaggcgtttcagaggaagaaacggcggaagaggattctaaggaagaatccgtgaaaaagggtcttttcgggaaaaagaaagagaaaaaagacccaagagatgaaaagatagaagaactgacagaccgccttcagaggaacatggctgaattcgataattaccgcaagagaacagagaaggaaaagacagccatgtttgaaatcggggcaaaggatattgtggaacggatcctccctgtagtagataattttgaaagaggccttgcagccatttccgaggaggagaagaacgctccttttgcagatggcatggaaaagatatacaaacagctgatgaaaacactggaagaagcaggcgtaaagcccattgaagcagtgggaaagccgtttgatcccaatttccataatgcggtcatgcatattgaagatgagtcactgggagagaatgttgtttcccaggaactccagaagggttacacctaccgcgacaccgtggtaagacattccatggtgcaggtggcgaattagtcatataaaactcagaaaacagataacattcacatttggtttattaaataggaggaaaaaactatgggcaagatcattggtattgacttaggtacaacaaacagctgtgtggccgttatggaaggcggtaaaccggttgtaatccccaacagcgaaggcgtaagaaccacaccatccgttgttgcatttactaagaacggagagaggcttgtaggcgagcctgcaaagcgtcaggctgtaacaaacgctgaccgcaccatctcttccatcaaaagacatatgggtacggactacaaggtaaccattgacggaaagaattacagccctcaggagatttctgccatgatccttcagaaattaaaggcagatgcagaggcttatttaggagaaaaggtgaccgaagcggttattaccgtaccggcatattttaacgacgcacagcgtcaggcaaccaaggatgcaggtaagatcgcaggccttgacgtaaagcgtatcatcaacgagccgacggcagcagccctggcttatggacttgataatgaaaaagagcagaagatcatggtgtatgacttaggcggcggtaccttcgacgtttctatcattgagatcggcgacggcgtcatcgaagttctttccaccaacggtgatacccgtctgggcggtgatgattttgacaaccgcattacccagtggatggtagatgaattcaagaaagcagaaggcgttgacttgtccggagacaagatggccatgcagagattaagagaggcggctgaaaaggcaaagaaggaattatcttcttctaccaccacaaacatcaacctgccatttatcaccgctacctcagagggtccaaagcatctggatatgaacctgaccagagcaaaatttgatgaactgactgctgacctcatcgagcgcacagcagttccggtacagaacgcgttaagagatgcaggcattacttccgcagaattaggaaaagtactgttggtaggcggatctacccgtatgctgtccgctcaggataaagtaaaacagctgacaggcaaggagccttccaagtccttgaacccggatgaatgtgttgccatcggcgccagcatccagggcggaaagcttgcaggcgatgcaggcgcaggcgatattcttcttctggacgttactcctctttccttatccattgagaccatgggcggcgtagctaccagactgatcgagagaaatactacgatcccgacaaagaagagccagatcttctccacagcggcagataaccagacagcggttgatatccacgtggtacagggtgagagacagtttgcaagagataataagacgttaggccagttccgtctggatggaattccgcctgcaagaagaggcgttcctcagatcgaggttacatttgatatcgatgccaacggtattgtaaatgtttctgcaaaggatcttggaacaggcaaagaacagcatattaccattacttcaggctccaacatgtctgattccgatattgataaggcagtaagggaagcagccgagtatgaggctcaggataagaagcgcaaggaaggcattgatgcaagaaacgatgctgactccatggtattccagacagagaaggctctgcaggaagtaggagacaagatcgatgcaaacgataaggcaactgtggaagcagacttaaatgcattaaaagaagcgattaacagagctccgatcgatgagatgaccgatgcgcagattgaagatatcaaggcaggcagagaaagactgatgaacagcgcacaggccttgtttgcaaaggtttatgagcaggcacagtcccaggccggagcacagggtgcaggccctgacatgggagcaggagacgcttcctatcaggagagcgatgtggttgacggagattacaaagaggtgtaaactagtctggacggttgacgggactttgggaaaagtgttgtagcgatacagcactttttccggagtctttcagtgcaattgctgtgtcatcctgtgctcatatatgaatgcagaatgcggattgaaacatgaaaggtagacctaagatggcagagaataaaaaagattattatgaaaccctgggcgttccaaaggatgcggatgacgcagccattaagaaagcttacagggcattagctaagaaataccatcctgacactaaccccggagatgccgcagctgctgagaaatttaagcaggcttccgaagcatacagtgtccttagcgaccctgacaagaggcgtcagtatgaccagtttggttccgctgcttttgacggaagcggaggagcaggcggtttcggcggctttgatttcaacggagcggacatgggagatattttcggggatattttcggagatatctttggcggaggacgaagaagcagcagcgcccgttacaatgggccatctaggggagccaatgtcagaaccagcatccgaattacttttgaggatgcgattttcggctgtgaaaaagagattgagatgaactataaggaagagtgttcctcctgccacggaagcggtgcaaaggcgggaacctcaccggttacatgtccaaaatgtaatggaaaaggaaagatcatgtatacccagcaatcctttttcggccagatacagaatgttcagacctgtccggattgcggcggcacagggaaaatcgttaaggaaaaatgtccggactgctacggcagcggatatattacaaagagaaagaaattcaaagtcactattcctgcgggaattgacaacggccagtccgtgcgccttgcaggtgcaggagagccgggaaccaatggcggcgagagaggcgatctgctggtagaggcagtggtatccaaccatcccatcttcaagcgtcaggataccagcattttctcaacagtgcccatttcctttacaaatgctgccttaggcggaagcatccgcattaagaccgtggatggggacgtggaatacgaggtgaagccgggaacccagaccgatactaaggtgcgcttaaaaggaaagggcgttccctccttacgcaaccggacgatccggggcgaccattttgtcactttggtggttcaagtgccggagcgcatgaacgaggctcaaaaagaagcgcttcgcaagtttgatgaagccatgaacggcacaggtgaaggcgaaaaacataaaaagaagggatctttaaataggaactccggaaggtacatgggtaggaaagaagggaaagtatgggaaggtttacaaaaaagctggccttaggagctgttgtattgtggctggcagttttatttcctgcggccgttttggccgctgacgggcagtctgtccgggattttccaggatggaacggttccggcacaaaaatcaaagggcctattgaaggaagtgaatcctttgatttttgggatgacgacgatgatgacgatgacggtccaggcagctacagctaccagaggggctggcggtacagcccttccggctggtggtttcagtacagtgacggaagctggccttccaacagctggaagtatcttgacggcagatggtaccggtttaactgggaaggccatatgctcaccggctggtattccgatgaaggcggcttgcggtactacttaaatcccgtggatgacggaacattaggtgccatgagaactggctggcagatcattgacggtaaggcttattattttaacaccatgtctgatggttatctggggaggctgctcaccaatacggtgactcccgacggatataaggtgggggctgacggtgcatggatacagtgagtttgatggaacggacttaaaaggtatggcgggaaatttctgctgtaccttttttatttgatttttatgtataataataatgaaattttcaggtgaatatttgagcggaggaatttcatggagcggcatatgcaggcaataaataatgctttaaaggtactttgcagtgaagaatttctgccttatgcagaggcagtttatctttagggagttgtgccggaggaaaccaaaggtttgacaatgccgacgtgaaaggaggcatataaagcagccttttattatgaataaatgatagtatttttaaagtttttgaatcaaatatgattttttatattttagtggagatattccatattcttttttaaataaatgatagaaatggctgatgttttgaaaaccgctttcgtaaataacatctgcgatttccatatctgtgtgggatagcaggttggcggcataattcagccgttttgcgttgatataggctgagggtgagattcccagatacttacggaaagttcggcagatgtgctcaggggagcgttctgtctgctggatcagataatccattcccattacaaggtttgctgcatttaaaagtccatctaaagcagacgaaaaccaggcgggcagatcaggagactgatctgtccgtttctgccgcattagctccggcataaggtaagaatacagaatatcgattaaaatcgcccgaagatgggtgtttttttcttccatagcagatgtggaaaactggttgaggaaggccaggcgattctggatcataacggtatcaattgtggtcaggcgtgcaacgggaacgtgagagctttccgaaagctcctgaaaaggattgggagaattgtagaggtagcagaacagtgccttcaatgtataggtgggaaaagccaggttgatatgtgtcgcggctccgttttgtatttttgtgtggacatccccggggcgaatcagaagaagatctccgcgggagagtcttaaatgatcattatttaacaagatatccagtacattttccgttactagtattatttcataaaaatcatgtatctgagggtattcatttttgtcaataagtgtacgaatggaatagtaaacttcacaatcacttggaaataccaatggagtattgacggttttaggatcagtttgcatagtaaacctcctggaagtttatagtaaaatccaaatcatttccatatatatatcaatataatacaaaaaatatcaaacgtaaagaagaaatctgaacggaattaagatatagtatcagtataaagaaatgagcttctgtaaacagtggcaacaattcatttaatactaggaaaataaatgatagaatcggtttaggaggacagaaatgaagctgggagtcggtttataccgttacatgctaaaggatgaagaatttacctttgcaaggcagtgcggctgtacggatttgattatccatcttgcaaattattacgacggcgaaggggatattgtcaaagcaacgaacgacaaggaaaattacggaacagccaaagcaggggagtctgtgtggagcctggaaagcatgctggcccttcagcagaaggcaaaggataagggacttaacatttacggaattgaaaacttcaatccggcagactggtacgatgtactgttagatggccctggaaaagaagaacagatggaaagcttaaagaggattatccgtaatgcaggaaaagcgggtatccgttgtttcggatataatttcagccttgcgggagtgtggggacaccagaagaccacagacgcaagaggtggagcggtaagtacctgctttgacgcagatcttctagaactggatgccaggattcccaaaggtgaaatatggaatatgacctattctggaaatgaacaggaaggatatattgaagatataggatatgaggagctttggagacggatgagatggtttttggaaaacattcttcctgtagctgaagaagctggggtaatgatggcgcttcatcccgatgatccgcctatgccgtttttgagaaatacgccaaggcttgtttatcagccggagctgtaccagaaggtgctggatctggttcccagcccgtcaaacggaatcgatttctgcatgggcagcattcaggaaatgacaaacggaaatatttatgatgccctggagcagtactcctcccagggaaagattgcctatgcccatgtgaggaatgtacggggaaaggttccaaaatatacagaagtattcgtagatgacggagatattgacataagaagaactctggatattctatataaaaacaatttcacgggcgtactggttccggatcatacgcctcaaatacagtgcggtgattcatggcatgcgggcatggcctatgcccttggatttataaaagcagaattaatgagtctgaaggactgaaaatgctggagaaggaaatttctctaaagaatggggaaagtgctgtaacaatcagggaaaaaatcacaaacttggcggaggagcccatggaacttatgtgggggcatcatccgacggtgggaaagccgtttctggatgaaagctgtcagattcatacaaatggaaccataggatttaccatggatgaaatggattttgagacccaacgcgtaaagccgggaacaaagtttgaatggctggtgacagacgatgaaacagatctttctctgattccaggagaaaaagccggaacagcagatatgctgtatgtgaccggtttcccggaaaaggcgtggtacagagtatacaatgaaaacaaaggcttaagctatggaatgagctgggacagcagtttttttccatatatgtggatgtggctggtctgcaggcctggaaaaagcggttgaaaatggaggtgctttccgcctgcaggcaaatgaggagaaaagaacagaactgtgcttttggattgaaaaaggaggagatttaaaatggcgttagatagacatgaattgctggcaattatgaaaaaagagctttacactccggttgtaggtgatatactggatcagataggactgtatcatcagttccttcctcaggcaatccggcctttgagggaggacatgaagctggcaggctatgctatgacagttttgatgattgacgtatatggtgagcagaaaaagccttttggacttctgacagaggcattagatgatttgcaggaggatgagatctacctggcaacgggaggcgatatgcgctgcgcctattggggagaactgctgacagccaccgcaaaaaagcggggagcagcaggagcagtggtcaacggctggcacagggatacaccccaggtactggatcagaactggcctgtattttccagaggctgttatgctcaggattcctcagtacggacgcaggtagtggattaccgctgcaggattgagctggacggagtcaccgtaatgcccggagacctgatttttggcgatattgatggtgttttggtgattcctgcagagcatattgaatatgtaattaaaaaggctcttgagaaggcacggggagaaaaaacggtcagaaaggccattgaggatggaatgagcgcaacagaagcctttgcaacatttggaatactgtaagggagaaatgatggagagagattacgcggtttatgtgggcacttatgcaaacgagaatgagtcgggaatttttaggtatgagctgaatggggctcagagaaagcttaagcttaggctggagcagcagggaattgccaatccatcctatctggcactttccggggatgataacacctgaacaggaaataacagactgccgctctccggtatgtctgacagctatagctgctgacatatcttaacatcggcttttcagctttacatggacgttaaatcagtccttccatataattatcagacggacatgaattttttatcataaaaaacaggggacgcgccagacagctgaaatgcttcagccatatgacgcgcctcctgtttttcattacaaatgtttttggtttgtaatttgtgaaaatagatcctgttccggtccaatcactcaggcgggtgtgatggggtgtaatgcatcaaggaatttcgtttacttgatattttttttgcccttgttctcggaacgaaacaaaagtattttcatccgttcaattagttaatgcagcagcatcaatttttattgcatcctttttcaaaaaaattatttattttaaaaaagatgaaatatcccttcaaatttcgttcatgttatacgcttgcaacacatttcattgtatgttatgatatcatgtggtttaataataagaacgttcggtgccctggcggctgaccgaggggctggttttctgttttttgaattcagcattgcttttttcgggaaaaccataccaaagaaaggaaacaatacatgtaccagtatttgatcgtctgccctcttgtttttctggcgggttttgtagattccatagccggagggggagggcttatctcccttccggcatatttagcggcaggaataccgccccattttgccattggtaccaataagctgggttctaccatgggaaccgttatctccacggccagatatgccaaagacggctatattaaagcaaagctgtcgctgtttgccgccctgtttgccgtggttggttctgccattggggcgcatttgtcaatgcttgccagtgagcgggtattaaagggaatgatgctggcagtgcttcccatagtcgctttttatgttctcaagaacaaaaatctgggagagcatgaggcagacacggaattgcctgagaaaaaaatgtttttgatcagcatgtgtgcggccctgatcattggctgttatgacggattttacgggccgggaacagggacctttttgctgctgatcctgaccggacttgcgaaaatggatgtcaggagcgcatcaggcaccacgaaggtgatcaacttatcatccaacgtcgcggcattggcaacttttttaataaacggaaaggttttgattcccttaggactggcgtcaggtcttttctgcattgcaggccattacatcgggtcaggccttgtggtgaaaaatgggttaaaggtcgtgcgcccggtggttttagttgtgcttttgtgcctgtttgtgaaaattataaaaggatagggaattgctatgaaatggaaaaagtttacgctgaccactaccacggaagccgtggacttgatcagcagcatgtttgatgagatcggaatagaaggaattgaaattgaggataacactccccttacggaagcggagacaaaaggcatgtttatcgacatcctgccggagctgccgccagatgaaggtcttgcaaaggtcagcttttacttagaaccggattctgacatagatggtatgttaaagcgggtggaagaaggactttcccagctttccatgttcacggacttgggagaatgtaccatagagtccggcgagacagaggacaaggactggatcaataactggaaacagtattttaagccgtttaccgttgacaatattctcataaaacccacctgggaggagatcccggaggaacacagggacaagcttttgatccaaattgatcctggaactgcctttggaacaggacagcatgagacgacccagctttgtatccggcagctgcaaaaatacgtgacaccggagaccactctccttgacgtgggcaccggaagcggcatccttggaatcaccgccttaaagctggggtaaaagaagcatttggaacggaccttgacgaaaatgccattgctgctgttaaggagaatatggaagccaatgatatccccggggagaaatttaaagtattgcagggaaatatcattgatgacagggacgtacaggagaaagccggctttgaaaagtatgatctggttgtagccaatattctggcggacatcatcatcctgcttcagaaggaaatctccgttcatatgaagaaaaacgctgttttcatcacttccggcatcatcaatatgaaagaggaagctgtgaagaaggcatttgaggaaaatgaagcctttgagcttgtggaaaccacctatcagggcgaatgggtttccataactgtcagaaaaaaataggaagaggaacgccttgcaggcatatctttatgtccaaaaggcatggacagggaagaggaaagcggatgtatcacttttttgtaaatccggaccagatcggagagtcggcgatacggattctgggaccggatgtgaaccatatgaaaaatgtcctgcgaatgggagctggggaacagatactaatcagcaatggtgtggataaggattacttatgtgaggtcgtggaagtggcttcttcagaagttacggctaagatcctgtctgtagaagaaggcggcgtggagcttcctgccaggctttatctgtttcagggactgccaaagggggacaagatggagctgatcatccagaaggccgtggagcttggagtataccggatcattcctgtggaaacaaagcgtaccgtggtgcgtctggataaaaagaaggaagaatcaaagctccgccgctggagggcggtttcagaaagcgctgccaagcagtccaagcggcttatcataccggaggtggccgggatcatgacctttcaggaggcgctggcctttgcagaagagctggacatgactgtcattccctttgaacatgcaaaggatatggctaaaaccaaagagattctgtccggaatcaagccggcaatgagcgcagggatatttatcggaccggaaggtggatttgaggattctgaaatggagcttgcagagcgttttggagcaaagcagatcaccctgggcaaacggatcttgagaacggaaaccgccggccttgccattttatccgtgctggctttccagctggaggactgacaggcgcaggaaataccctgcggtatccttggcacccggtacacccgatcatgcggggggcactgaagcggggcggcactgccggaaatacgggcagtaagaggaacgcctttcaggcatacctttatgtccaaaaagcatggacagggaagaggaagcacccttcgggcatacctttatgtccaaaaagcatggacaggaaagcagaaaggaaagagccatatatggaagcttactttgataattcggcgacgaccaaggtgttggagcctgtaaaagatattgttgtaaaaattatgacagaggactatggaaatccttctgccaagcataaaaagggaatggaagcggaaaagtatattaaggaagcggcggagatcatagccgggactttaaaggtagcggcaaaggagatcgtctttacctccggaggttccgagtccaacaacatggccttaattgagggggcaatggccaataaaagggcaggaaaccacatcatcagcaccggcattgaacacgcctctgtatacaatcctctggcatatttagaagaacagggtttttccgtgacgtatctgcctgtggatgcccatggccatatccgtctggaagaactggaagcggctatccgcccggagaccattctggtttccatcatgtatgtgaataatgagatcggcgctgtggagcctatcgaagctatttcaaagatcattaaaaagaagaatccgtccatcctgtttcatgtagatgccattcaggcttacggaaagtttgttatcaggccaaagcgccaggggattgaccttttatccgtcagcgcccataagatacacggaccaaaaggggtgggctttttatacattgaccagaaagtgaaaataaggcccttgatttatggaggcggccagcagagaggcatgcgttccggtacggaaaatgttccggggatcgcaggcatggcagcggcggctaaaatcatgtatacggatcatggagagaaaattcaggctttgattgcccttaaggattacatgatcagcaggctttcggagatccatggcgttacggtaaacagccttcccggcgatttatcagcgcctcagattgtcagtgccagcttttccggcatcaggagcgaggtgcttttgcatgcccttgaggaacgggatatttatgtttcctcaggttctgcctgttcttcaaatcatccggctgtcagcggaactttaaaggggatcggcgtgaaaacggaacttttagattccacgctgcggttcagctttggggcttataacacaaaagaggaagtggattactgcatggatgcgctaaaggagcttttgcctgttttaaggcggtatcagagaggctgagggagtctgcaggaaaatagtaataccctccgggtatacctttatgcccaaaagtcatgggaaggaaagaggaaaggataacagatgcaatatcaatcatttttaatcaaatatgcggagatcggagtaaaaggaaaaaaccgttatctgtttgaggatgccctggtagcccagatccgccactcattaaaaagagtggaaggcgattttgtggtttccaaggagtcaggacgtatttatgtgaccgctgagtcggaatatgactttgatgaggtcgtggaggctttaaaatgcattttcggcattgccgccatctgccccatggtgcaggtggaggacgatggttatgaggatttaaaaaaacaggtgctgtcctatgtggatgaattctacgaggataagaattttacctttaaggtcaatgcccgcaggggaaataaaaagtatccggtaaattcggaacagatcaaccgggaactgggggaactgatccttaacgcttttccggagacaaaggtggatgtccataagccggatatgatgcttcatgtggaagtacggaataagatcaacatttactcccattccattccaggtcccggcggaatgccggtaggtaccaacggaaaggccatgcttcttttatccggaggtatcgacagcccggtggcaggttatatgatcgcaaaacggggagtgaaaatcgatgccgtttatttccatgcgcctccttataccagcgaacgggcaaagcagaaggtgatcgatctggctaagctggtttctaagtattccgggccggtccatctgcatattgtgaatttcacggatattcagctttatatttacgatcaatgccctcatgaggagcttaccatcatcatgaggcgctatatgatgcggatcgcagaacggctggcaggggattgcggggcaatggcccttataaccggagagagcatcggacaggtggcttcccagaccatgcagtccctggcagcaacggacgcagcaaccaccatgcctgtattccgccctgtcattggctttgacaagcaggagattgtggatgtatcggaaaagatcggtacttatgagacatccgtgcttccttttgaggattgctgtaccatttttgtggcaaagcatccggtgacaaagcccaatttaaagatgattgagcggtcagaggaaaaattagaggaaaagatcggggaaatggttgagacagccataagcactgtggaaaaggtctggtgttaaaagaaaaataaaatcggggtccggctccttttggaaaaggccgggccccgaaagacattaattatgcttaatctacaatatatggagataaaatatttaagatttcatcggcgttgttttcggagtgaatatttaaatcaatgggtttggaaagatccaggctgaaaatgcccataatagactttgcgtcgattacgtatctgccggaaaccagatcaaaatcagtatcaaattttgttaaatcatttacgaaagattttactttgtcgatggaatttaaagatatgcgaactgttttcatgtgaaaaacctccttaagtgagctgtttttattttatcagggaaccgcccctttttcacttcaatactactgatatattgtataaaagtcaatggtaattttacatgaaaatactgaaaataatctgattatttagataggagaaaataaaatgaaaaaggcagccctgcataatcttggatgcaaggtcaattcctatgagacagaggccatgcagcagcttcttgaaaacgccggatatgaaattgttccctttgcagaaggtgcggatgtttatatcatcaatacctgctccgttacgaatattgcagaccgcaaatccaggcagatgcttcacagagcaaagaaaatgaatcctgaggcagtggtggttgcggccgggtgctacgttcaggcagccggggaagagcttaaaaaggatgaggcggtggatctggtcatcggcaacaacaaaaagaccgagctggtttccgttttggaggattattttgccagcaggaaagggcctgaagaggaaacaattattgatatcagtgacaccagggagtatgagaacctgtccattggcaagattgcagatcacacaagggcctttatcaaggtccaggatggctgcaaccagttttgcagctactgcatcattccctataccagagggcgggtgaggagccggaagccggctgaagtggtggaagaggtaaaacgtctgacttcctccggttatcaggagatcgtgctcacggggatccatttaagctcttatggaatggattttccggaggaggagcggcttacccttttggatctggtgaaaagcattcatgaagtggaaggcttaaaacggatccgccttggttccttagaaccaaggattgtgaccgaagagttcggcggggagcttgcaggacttcataaaatatgcccccacttccatttgtcccttcaaagcgggtgcgatgatactttaaagaggatgaaccgccgctacaccacgaaggagtatttaaactgctgtaatattttgcggaaggtctttaaaaatcctgccatcaccactgatgtgatcgtaggatttcccggggaaaggccagaggaatttaaggccaccagggaatacttagaaaaagtccggttctatgagatgcatgtttttaaatattctaaaagaaacggcaccagagcagcggtgatgccggaacagataccggaatccatcaaggcggaacgcagcaatgaactcctttgcctggaaaaggaaatgtcccttgagtaccggaaatcgtggctgggatgcaggacagaggtgcttatggaagaggaatactggtggaatgaggcccgttacatgatcggtcatacgagagaatatgtaaaggcggcggttccatttgaagaaggcttaaagggtgcggtgatagaaggaattcttgtggaaatgatgaatgatgaagtggcatttttacagcgctgacagacaaaatttatttttgtcttgccgaatccataattttggtttagaatatagtagaacagttaaaggacgtgagaaacatgggcgatattcataatacgcaatttttcaaggcagtacaggaaaacaaactgaatgtaagccaggtattggaacaggtttatattgccctcactgaaaagggctataatcctattaaccagatcgtgggttatattatgtcaggggatcctacttatattaccagccataagaacgccagaagtcttatcatgaaagtggagcgggatgagattttagaagagcttatgagggtatatattaatacgaagttgaagtaagtttgtggataatcttaagtctagctgtcagatgaagtgaaagaaggcggagtctggcagtttgtttttatacggttggctttggaccagctttattttgctgcacaaattatgacagaatacgcgaaaccctggcagcctgccggattcgttaggagacaaaatatgaggattatggggcttgattacggttctaaaactgtaggagttgcagtttccgactcacttggtataacagcccagggagtggagacaattacgagagaagaagagaataaactgagaaagacctgtgccaggattgaggaactgatccgggaatatgagattgaaaccattgtccttgggtatcctaaaaatatgaataactcagcaggcgaccgggctgagaaaacggaacagtttaaagagatgcttatcaggcggacagggcttcccgtcatcctttgggatgagaggcttacgactgttgcatcggagagaatattacaggaaagcggcgtgaggcgggaacaccgcaaggcggtcattgataaggtggcagcaggactgattctgcagggctatctggacagcttaccgacaggaggcaggaatgaacagtgaagaaatgaaaattaccctgacaacagatacaggggaggacgtggaattttacgttctggaagaaaccagaatcaatggaatgaattatctgctggtaaccgatgcggcagatgatgaagatgaaggagaatgttacatcttaaaggatttgtcaaagcaggaagagactcaggctttgtatgagtttgtagaggatgataacgagatagattatttatttaagatattttccgaactgctggacggagcagacgtggatattgaagtttgaaagaaaaacatctttcatgatggtgagcaattgagggactgtcacatgaaacaggaagtttttaaaaatatgcttcgagagaaaggactcaaggtgaccaaccagcgtatgctggtgctggaactcatggcagagcgccccgggcagcatctgactgcggaagagatctatgatctggccaggcagaagtacccggagattgggcttgctacgatttacaggaccgtgcaggtgctggtggatttatcagtgatcgataaggtcagttttgacgacggatttgcccgctatgaattagggggcttggatcgtgagtccagacatcaccaccaccacgcaatttgcaaccgatgcggaaacgtattttcctttcaaggcgatttgctggatacgctggagcaggctcttcttgacaggtcaggttttttagtgactgatcatgaagtgaagctgcacgggtattgcagggaatgccgggaggcaatggaagaagaacaggacggaaaatcataagatggaggtaaaatattgaaaaaacaagacagcaacgcgaaagttaaaatcattcctttaggaggaatggagcagattggtatgaatatcactgcttttgaatatgaagacagcatcatcgttgtggactgcggactggcattccctacggatgatatgcttgggatcgatctggtaataccggatgtttcttatctgaaacagaacattgataaggtaaagggatttctcatcacccatggacatgaggaccatatcggcgcccttccctatatcttaagggacattaatgtaccggtatatggaacaaagctgaccattgccctgatcgagaacaaattaaaagaacataatttactgaaaaacaccaagagaaaggtgatcaagcacggacagtccgttaacttaggctgtttccgtattgaatttattaaaacaaaccacagcatcgccgatgcttccgcacttgccattttctctccggcaggcgtgatcctgcatacaggcgattttaagattgactatactcccgtattcggggaaccggctgatttggagcgttttgcagagctgggcaaaaagggagttcttgccatgatgtgtgacagcaccaatgccatcaggccaggattcactccttcggaaaagaccgtgggaaaaacctttgacaacatttttgcagaccataagaacaaccgcatccttgtggcgacctttgcctcaaacgtggaccgggtgcagcaggtcatcaactccgcggccaagtacggacggaaggtagtggtagagggccgcagcatggtcaacgtcatcggtacggccagcgagcttggctatatcaatattccggacgggacccttattgatattgaccagctgaaaaattatcctgatgagcagacggtacttatcaccaccggaagccagggggaatccatggcagccctttcccgaatggcaagcagcacccataagaagatctccatcaagccaaccgatgtgataattttaagttctcatcccattccgggaaatgaaaaggctgtttccaaggtcatcaacgagctttccatgaagggagcagaggtgatcagcgatgatactcatgtgtcgggacatgcctgccaggaggaaatcaagctgatgtatgccctggtccgccccaaatatgccattccggtccatggcgaataccgtcacatcatggctcagaaaaatctggttcaggccatgggaattcccaaggagaatgtggtcgttatgtcctccggcgatgtggtggaggtaggacaggaatcctggaagattgtagatcacgtgcaggcgggaggaatcctggtagacggccttggcgtgggagatgtgggaaatattgttttaagagacagacagaacctggcccagaacggaatcattgtggtggttctgaccctggagaaatactccaaccagcttttggcagggccggacattgtgtccagaggatttgtttatgtgcgtgagtcggaggatttaatggagcaggccagaaatattgttaacgatgctgtttctgattgtctggaccgccatgtcaatgactggggaaagattaaaaacgttattcgggacagcttaagcgacttcttatggaagcgcatgaagcggaatcctatgattctgccgatcatcatggaagtataacagggggcatacctttatgtcctgtgaaacggacagtaagaaggaaacacccttcgggtatacctttatgccctgtgaagcgggcggtaataatgaaaggaatgcaggatatgagccgggcaacgaaagagattaataaaataacaggagcagtcatagggatttcaagcaggcttattatcgtcgccctggtgatccttctgctttatgagggagttaccagaggatatgagttcggccatgaaatattctacgcttctgccatggaagcggagccggggcggaacaaggaaataaccgtaagtaaggaaacctctgtggctcaggcagcaaagcttctaaaggacaatggtctgattgccaatgaatattcctttatcatacaggcggagttttttgattataaggtaaatccgggagaatataccttcaacacttccatgacctccaaggagatccttcagatgatgaatgagaatacaggggaaaaggaagagaaaaaatgattgtaaatgacaggataacggattatatcaagtctctggaaacagacagaagcccgctcctttcaaaaatcggaaaaaaggcgagacaggaaggtgtcccaattatcagggaagagaccgctgccttccttcagaccatgacggcggccatgaggccaaagtccattttagaggtgggaacagcggtgggttattccactcttttaatggctgagaccatgccgcctgactgccatatcactaccatagaaaaatatgaaaagaggatcccccaggccagggaaaactttaaagcggccggggagacccagcggatcacccttcttgaaggagatgcgcaggagatattaaaggggctgtccggcccctttgatcttgtctttttggatgcggccaagggacaatatctcctgtggctgcccaggctcctggagcttatgagatccggcggaatgctgatttctgataatgtccttcaggatggagatatcatagaatcccgctatgtggtggaacgccggaacaggaccattcacggacggatgcgggaatacctgtatgaattaaagcattcaaagcagcttaccacctccattgttcctatcggtgacggcattaccgtcagcatcctaaaataatttacttaatgaaggcggacaaggtgtgcctgaatttacactggagaatttagaaaatagaaaatcagccgttcggcgggccataagccagccggactttcataatttatcaggagacaaatacgagagaggagttttatgagaaagaccgaacttttgattcctgcaggcagcctggaggtattaaaaaccgctgtgatttacggcgccgacgctgtctacatcggaggagaagcctttggccttcgagccaaggccaagaattttacaatggaggaaatccgggaagggattgcctttgctcacgaaaaaggggtaaaggtctatattacggccaacatactggcccataatgacgacctggccggagtggaagaatattttaaagaattaaaggaaacagggcctgatgccctgatcatttccgatccgggagtatttgagatcgcaaagcggatcttgccggatatggagatccacatcagcacccaggcaaataataccaattacgggacttatttattctggcaccggcttggggccaagagggtggtatccgccagagagctttccctggcagagatcaaggaaatacgcagccggattccggaggacatggagatcgaaagctttattcacggagccatgtgcatctcctattccgggcgctgccttttaagcaatttcatgaccggaagagatgccaatcagggagcctgtacccatccctgccgctggaaatattccattgttgaggaaaaacgtccgggagaatatatgcctgtttatgaaaacgagcgggggacttatatcttcaattccaaggacttgtgtatgatcgaacacattccggagatgatggatgcgggaatcgacagccttaagatcgagggacgcatgaaaacagccctttatgtagctgccgtggcaaggacttaccggaaggccattgatgactttaacaaagatccggagctttatcaggccaacatggagtggtaccgttccgaaatcggcaaatgcacttaccgggaatttaccaccggcttttactttggaaaggccgattccaccacgcagatttatgataacaatacctacgtaaaaaactacacgtatctgggaaccattgaagcggtggatgagagaggttttgcccgcaccacgcagaaaaacaagtttattgttggcgagactattgaagtgatgaagcctgacggacgtaatctggaagccgttgtgaaagccatctatgatgatgagggcaaatcccaggaaagcgcacctcattccagagaagtcctttttgttgatttaagtgtggaaatggagccttatgacatcctgcgccgcagtgagatggactgatataaaataaaaaccctcagggccgctgatatcctgatcatgtttgcagttgtaagatgcaaacaaaaatgtggtataattccatatgcaaacaaataagtttgacattccgccggttgcgtgtataatggaaattggaggcaggaactaatatgaactacagtgcgctgattatagatattaaaaaatccaaatcttatgatataggtacacgcaatgaggtacaggaatatttaacgaaatgcattaagatgttaaatgacatcaacaaagaagtacttgcgtgtgaggtgacgtttagcggaggcgacgagcttcagggactgtttctaaccccttttgcagcggtatcatattggagaattctggaacttatggttcacccggtacaaatacgcgcgggcctgggagtgggggaatggaatgtgaggatagagggaggaacctctgcccagcaggatggcccggcatatcaccatgccagatatgccattgaagaggtatataaaaaacaatttcaaaatatcagaatatactcaaaatcagaaaaagatgtatttgccaattatctgctgaatgtttcctgcggttacaaaggcggtcagaattatatgcagaattttcttcagctggtctcagagcttctttacccttttgtggaagaacggaagcggggagcagtgagagatcatgctttggaaatgcttaaattaaaagaaagctatggagtgaaggaaaaaacatacggcaggattcagaaacaagatgtggatttttccaatgggaatgtggccatccaggatgaaatattgataaccggcaatacgacagaggctgatgaggctgtttacagaaaaggaatgaataccaggatcgctgacatcatgcagagatccaggcaaaatatagacacagtcatgaaacggggaaatgtccaggtgatccgcagtatggattatatggcgcttcaatatttaaaaaacaattacggtgaaaaatatgattcttaaattactgttgatagggcatatcataggcgatttctatgtccagactgatgagatcgcagaaaagaaaaagaataatttctccatcctggtgatgcactgtatgtgctattccttttccctgtttatttgtgcggtgattcccctgaccagggatcaggtgcccggactccttattttttctgttcttgccggaatatcccatggagccattgatgattgtaagatatggattgaaaaaaacagaaatttaaaacccggtcaggatatctgtctgtttttcattgaccagatcttacatgctgccatccttataatcggatgcagcctgacagggcttacaggcggggcgtatatacatattttaacaggaagctatgatacaaaagtactggctgacatcattaagatggcaatgggaatcttaatctgcggccatccggcttccatactgatcaagctggtctttgcagcagtgacaaaggaacgtgacacagaaaatcccaaaatcggatcctatataggaatattggaacgtgaaatcatattcctgctgggcatgatagggcagtacagtaccattggatttgtgctgacggcaaaaagtgtggcacgttttaaaaagctggaagatcaggcgtttgcagaaaaatatctggtgggcacattattaagtgcattcatagccattgcctgtgccgtgacaaacagctattttaagatataaaatcagattacccatatgctttgggcggaagaggcggagagaaccggaaagaggttttctccagcctcttttttatgctaaaaaatgaaagcgggattttctttctttgaatgatcacagtttaaggtaaaagtataaagaaaatgtgtattatttataaaaaattatttattttttataaataatgcatatagtatctgcatctttcatgtgatatattatatgagaaaactgatatatcagatgaaattttagttgcgacaccaagaatcaaatccggaaacagacatgacgtagctgtaaaaaattacaattaaaaaggagagagaaacgatgcttgacattattactggcatattgctgctgctggtctttgtggggctggtagtgtactgcatgaaaggcggaaatcttttgatcggatttattgccacagccgttttatggtgtttgatcggacgtgtgccgatcaatgaggtggtaagcgatgtatttcaaaagccgctggatgattacggaaagaccatagcaattataatctttggtgcatggtttggacgtattctggttgatacgggaattgccggctatatcattaaaaagaccgtggaatttgcaggagacagacccctggtaaccacattgctgctgtgcattatctgcaacctgctttttaccagcgtttttggagtaggctccgttatggccatcggtatgatcgtgcttcccattctgttttccatgggagtggagaagagggcggctttaggcgcttatatgctgtccgttgcagggggaatgtacttaaacatcgcttatgtgagccagtttgaaaaagtatttggtgaagatgtggcttcctacaatgacaactacatccgctttgccctgatggcaactgccattcacatggtcattatgatcgcatttgttgtgttccatcatttcaaaaacagcaaaagaggaagaaggcgggcctgggaagcgggcgtacaggaaagctacgaagaaaagccccttggctggtactgctttatcgtgccttttgtgcccattgcaatggtaggaattttcaaatggcagccggttccggctttcctgttaggcagctttataggacttttgttcacacggaatttaaggacttacaagactgctgtggataagacacaaaagacattatacgacggtgttgcggacagcggacttttgatcggtatgctttacagcgtaaacattttccagggagctgcgacgaaggtggtgccttatcttcagaccttgcttggtgatgtagttccaagatccgaaattgtagttctggcggccttctgtattctggcgcctctggcattgttccgcggaccgctgatgatctggggctccggcattgctctgtattcgattttaaatgcaacgggtgcgtttaatcctcatttcctgtttgccatgttcctgattcctccggttgctattgtagcaagtgcttgtcctacccagtcctggaccatgtggggcttaagctatgcaaaggtagagccaaaacagtacataaagaccaatctgccgtgggcctgggcaagccttgttgccattgaaatccttatttattttaccataggaagaatggtttaatgctcagctttggcagatgaaaaagtttcacagataagggcatgcaaaatgtctgtatgcccttgcctgttttagatggaggacaacgaatgagcaaccgagcaataagaattggcattgatgtgggaggaacccacacaaaggccgtagcaatagacaacagtacaaacgagattgtgggaaaaggatccgtaatgacaacccaccatgacgaaaacggagtggcagcaggtgttgtggaagcatttaagaaatgcctttctgagaacgatattaaaccagaggaagtgatttttattgctcacagcaccactcaggctaccaatgccctgctggagggagacgtggcaaaagtgggtgtcattggaatgagcggcggcggtctggaggcattctttacaaagcgccagacaaagatcaaggatattgatctgggaaccggaaagtggatcaatattgaccatagctttatgaaaaccaaggacatgactccggataacgtatcttctgtgatcaaaaagatggcagatcagggggataaggtgatcgtggccagcaaggcatttggcgtggacaatatgaaggaagagcgcatggttgcggagattgcagaaggtcagggaatcccctgtaccgtagcttctgatattacaaagctctatggtctgaccacccgaacccgaaccgcctgcttaaatgcgtccatcctgcccaaaatgctggatacggccaattccacagagcgaagcgtacgtgccgcaaaggtaacggtccctcttatgatcatgcgcggggacggcggggtcatggaaatcaacgaaatgaaaaagcgcccgatccttaccatgctctcaggacctgcggccagtgtaattggtgcccttatgtatctgcgggcttccaatggcatttattttgaggtcggcggaacctccaccaatatcggggtgatcaaaaacggccgtccggctgtggattattccattatcggagggcacagaacctacgtaaacagcttagatgtccgggtacttggtgttgccggcggaagtatgatccgtgcgaaaaagggcgcgatcgttgatgtgggcccccgttccgcacatattgcaaatatgggatatgcctgttttacagagcctgcgctgtttgaaggggcagaattatattacatcaagccacgtgaaaatgaccccagcgactatgtggcggtacgcttgaagaacggcgaaagcgtaaccatcacaaatacctgtgctgccaatgtactgggaatcctggaagacggggattatgcaatgggtaattacgaatccagctgcaaagccatgcagctgctggccgatgaagtggggatgtccctggaagatacggcaagggcggttcttcaaaaagcttgtgataaaatcaaacccgtcattgaagacctgatcgataaatacaaaattgaaagagaacagatcgtactggtaggtgcaggaggcggtgccggaacactgttgacctttacggcaaatgaaatgaattttaaataccagataccggtgaatgccgaggttatttcttctatcggcgtggcgctggccatggtcagggaaatggtagagcggaccattcccaatccaactgcagaagatattgccgcccttaagaaagaagcaaaggctttggcaatgaacagcggtgcagtggaagacagcattgaagtctatgtggaaattgatgagcaggcccagaaggttacggccattgccatgggatccacagaagtgaagaccacggacttaatgaagaattgtgatgaggaagaggcgcttacaattgcggcggaatccattggcctggaacggtctaagatgaagctggcaggaagcaatggttccatatttgtggtgactgctgaaaaagacgggaaaactcccgtgagagtgatagataaaaaaggctttgtgaaggtgcaaagatccaatggcacggtgctggttacaacaaaatccaggctccgtgaggatttgaaacttgcctgggataaggccagcaacttttcaagtgaagtcaggatcaatccggattgttatattgcctcagaatccagagttatcgattattccggaattccggccttggatcaggtatcaggattagccggggttgagcttattgatatcaaggaagatgctgaaatcatcctgatcctggcgcgcaacgagctgtaaaaaatggagtgtatgcgggagcttatagaaaaaattgctgctgtccatgatgtaaaatggtatagccgtgtgctaaaaaatcaaccggcttcctgtgaactgtcaaaagaggaagaacgggaaattctgttttactccatggaaacggcagaaaaatatgcgtcacagttaaagaaggactatggggccgtttccggcgcttctcttgccggtacactgggtttaaccataaaaagaacaaaagaagaacttagaaaaccatttttatatatgggaatatatgaaccggaagaaggtactgtcattttaaatgacagtaccttaaacgcaataaaaggttttataaaagaatacggtttaacggaaataatccgggaggaagcactggaagaaatcgttctgttccatgaaattttccactgtattgaagaaaatacgccgggaatctatacccgcagcaaaatgttaaaaaggccggtatggaatctgtttcctaagtccagaggccttgacggggcaggagaggtgggagccattcatttttccaaaataatgagtgggctatcctattctccctgcctgtatgaaatgtgtttattgattaagacgggtgtttgctctattgattttttctcctctatcctataaaatggaatatgattattttattgttggaaaatggcgattattaaaaaaatatggtcaattataaaaggaggttcaaagttggaagtatataatggagccatatcgtcttccgctgacggccaggaggaggcttcccgtcagggggaaagcacagataacaatgcgtaccagcttctccgtgaaaaaatcctggatcttcatttaagaccggggatcaacttaagtatcagggatatttgtgatttattaaacattgggcgcactccggtcagagatgcgctcatcaggcttgaacaggaagatctggtgactcttctcccacagagaggaacaagggtgtccaagatagatttagatagagtggaacaggaacgttttttaaggcttgccgtagaagaagaggttatgaagctgtttatggcatgccatactcctacggatttgttggaattacagaacaacctgatggaacagaaagcctttactgagacaggcaatggtgatgtaaggaagttcctgcatatggatgatgagtttcataagatattttaccgggtaacagaccgccttttcagctttcagaccatcaataatgttggaggccatttcaggagaatacggcttctaagctgccgggaaatgcagagtgtaaaagaaattgttgcacagcatgaagaaatcatactcgctctccagacaagagataccaaggcaatgctgtacgtgctgcaaaagcacctctttaaattggacagggacaaaaaagacttaattaaaaagtatcccagtttgtttaagcgcaacatcaatgaagattacgtgaatattccatggacagatgatttctttgaaacatttcagtcctttatgtagggaggacttgaatccggtaaaactcaagtataaatgattgacaaataacaattcccgtggtagagtttttttaaacctatgaggaagagcaagtaccgttgtacttaccacacagagagccgcaggcggtgggattgcggcagggaaaggcaattgggaatgggcttctgagggcgaactgaatggtaagtaggtaagccggagagtaaactccgttataaaagtcagcatatgtcagtatgcgtgagaggatgcgccagatgcatcaagccgggtggcaccgcaggagttatgacgattcatactcttgtccctgcaataatttattgtgtgggataagagtttttttattgtaaaaatctacttatcccggaaagaagaaacaccctacgggtatacctttatgcccataaatcgtgggcgggaaagaagaaaggagatttttgcatgagtgaaaacaagattccctacaaaatttatctggaagaaagcgagatgccaaaggagtggtacaatgttcgtgccgatatgaagaataagccggcccctcttttaaatcccggaaccttacagccaatgtcagaggaagaacttggaactgtattttgtaaagaactggtaaaacaggagctggataatgataatcgttttatagaaattccggaaaaaatccgtgacttttataaaatgtaccgtccggcaccgttagtaagagcatactgcctggaagagaagcttcagactccggctaaaatttattacaaatttgaaggaaataatacaagcggaagccataagctgaattccgctattgcacaggcttattacgcaaaggaacaggggttaaagggagtgaccactgagaccggggcagggcagtggggaacggctctttccatggcatgctcttatctggaactggattgcaaggtgtatatggtgaagtgttcttatgaacaaaagcccttccgcagagaagtaatgcgcacctatggggcaagcgtgactccgtccccgtctgagacaacagagataggaagaaagatcctggctgatcatcccgggaccacaggaagtctgggatgtgccatttctgaggcggtggaagtggcaacccatacagatgggtaccggtatgtgctgggaagcgttttaaaccaggtgctgcttcatcagtcagtgattggagtggaagccaagattgccatggataaatacggaatcaagcctgatattatcatcggatgtgcgggcggcggctccaatctgggaggattgatatctccgtttatgggtgaaaaactcaggggcgaagcagattaccggtttattgccgtagaacctgcatcctgcccaagcctgacacgaggcgtttttgcttatgatttttgcgataccggaatggtatgtccgctggctaaaatgtataccctcggaagtggatttatcccatcagcaaaccatgcgggtggcctgcggtatcatgggatgagttccacattgtcacagctttatcatgacggatacatggaagctcgctcagtagaacagacagctgtatttgaggcagcggaacagtttgcgagagtagaaggaatccttccggccccggaaagcagtcatgcgattaaggcggcgattgacgaggctttaaagtgcaaagagacaggagaagaaaagaccatcctctttggccttaccggcacaggatattttgatatgttggcatatgagaagttccatgacggagtgatgacagactatatccccgccgatgatgatctgaaggtcggatttgacggaattccaagattcccgggtaatatggaatagaaacaccttttatgaggaacaagggcggcttgcaaaagaaaacaggtactggttttcttctgcaagccgccttttctgcttcattataagagtatcaggtgcatccatacctgattttcctataatttcagtgacagttgtagaaattcctatattgtggtatgctataaaagaattatgcccagaatttacctgattttaaaacgtgtagaatggaggctggcatatggcgttaatattttggctgatagccgtttcctgcattatttattatgttgtgatcattctttattcaggtctgaccacatctctttcttttatatggcttgtatttgctggcatatgcatattgctgccggtgggttgggagacttatgcgaagcataaggataaggttcccttatggattccggtgtcggtgattaccatgtgctgtacgggaattctggtatttctggtggtggagatcctggtgtttacgggagttgctgccagggatgcttccaatctggactatgtcattgtgctgggagccagggtaaaggaaacaggaatcagcaaatccttaaagaatcggctggatcaagccatggagtacttggatgacaatccgtccacgattttggtgctgtccggcggccagggtgatgatgagcctgtcagcgaagcagcagccatgcgggattatctggtctttaacggagtgagagaggaacagctgatcttggagacccgttccaccagcacggttgagaatattgcatacagccgtgtggccattgaagaggaccaggcggaaaggaaagcacgccggcaagatcagccgattttcatggagccgggaacctttgaggaggtgccggataagcccattaaaattggtgtcctcaccagtgattttcatgtgttccgcgcgcttcagattggaaaaaagtggggaataccggatatctatggcatatcctgtgaatcagaccccattcttttcgtacacttttgcatcagagagtgcgcagccatattaaaagacaaattagtgggcaacatgtaattacacgaatgcaatgagcagtgcgaaacaggacaggagaaaagttacgttgtgtccgcacataaaaaactcttttcatggcctgtttcatagggcgaatgcccgtgggcaagggaatcttacagattcccttgctgcgctgctgacttacgtataatatgaacatgcaggaggaaataacaaggaatgaatcaatttaaaaaccttgcagcctatgaggttgtggaagaaaaagtaattaaggagatcaacgcatcgggatgcgtgctccgccataaaaaaagcggggccagagtcttttgtgtgtcctgcgatgatgagaataaggtattttccatcggattccgtaccccgccgtctgacagcacaggagttgcccatattctggagcacagtgtgctctgcggttccgatcagtttcctgtgaaagatccgtttgtggagctggtgaaaggctctcttaacaccttcttaaatgcgatgacctatcccgataaaacggtatacccggtagcgagctgcaatgacaaagattttcagaatttgatgaacgtgtatctggatgcagtatttcatcccaatatttataaagaaccaaagattttcatgcaggaaggctggcattatgagctggaaagcctggaatctgatctgatttacaatggagtggtatataatgagatgaagggagcattttcttctccggaagaagtgctggaccgttacaccaggaaaactcttttcccggataactgctatggccaggaatcagggggagatcctgcctttattccggacttaacctatgaagacttcctggcttttcatcagagatattatcatccctccaacagctatatttatctttacggagatatggatatggcagaaaagcttgaatggatcgatgagaaatacttaagtcattacgatgaaataaccattgattccaggattccaaggcagaagccatttttaaaaccagtggaaggggagactttctactccatcaccgaaggggaatccgaagaaaatgctacctatctttccatcagcacggcagttggtacggggctggatcccaggctttatatagcctttcagatcctggaatacacccttttggatgctcctggggcgcccttaaagcaggccttaattgacgccgggatcggccaggatattttaggcggatatgaaaacggcattcttcagccctatttctccgttattgcaaaaaatgcaaataaggaacagagaggggaattcctggctgttgtaaaagggactttaagaaagcttgctgatgaggggatcaataaaaagagcttgaaggccggaatgaactactatgaattccgctatcgtgaggcggattacggttcagcgccaaagggcctgatgtatggtcttcaatgcatggacagctggctttatgacggggatcccatgatgcacttagaatatcagaatacctttgcctatttaaagaaagtggtggaggacggatattttgaacagctcatcagggaatatcttctggataatccttttgaagccttcttaagcgtgagtcccaaaaagaacttaacggcaatggaagaggagaaggtggcgaaaaagctggctgtttacaaagcttctctctcagaggaagagcttcttaggctgacggaagagacaagagccttaagggaataccaggaaactccatcttcccaggaggtgctggaactgatacccatgcttcggagagaggatatcaccagagagccggaggagatcatatgggaggaaaagtcggcccatggcgtcaaggtcatccatcatgagatgtttacatccggaatcgggtatttaaaagtgatgtttgatacctccgcagttcctgtggaggacctgccttatgtgggatttttgaaatccctgctgggttatgtgaatacggaaaatttcacctacggagatctgaccagtgagatccatttaaacagcggcggcgtcagcttcagcgtgacctcttaccctgatttaaggaataagggagagtttaaaggatttttcatggcaagcgccagggtgctttatgagaaactggattttggcttctccatactcggtgagatcctgacccgttctattttggatgatgaaaagcgggtaggagagataatcagtgagaccaggtcaagggccagaatgaagctggaaggttcctgccattcggctgcagttgccagggcaacttcctatttttccgccacctcttattttaacgatctgaccggcgggatcgggtattatgaatttttagagaatctggaaaaggaatatccttcccataaaaaggagatcattgcccgtttaaaagcggtgatggataagatttttaccgtgaaaaacatgctggtcagctatacggccgatgaagaaggatataaactgcttcccaatgctttggaaaagcttaccgcattactgcctgaaggagaaggaacccgctatccctttgttttttttccaggaaacagaaacgaaggcttctgcacggcttcccaggtcaattatgtggcaagatgcgggacctttgcaggcagcggacaggaatataccggggttcttaaaatattaaaggtcattttaagctatgattacctgtggatcaatctaagggtcaagggcggtgcctatggctgtatgagcggattcggccgttcaggagaagggtactttacctcttaccgggatcctaatgtagttgaaacaaaccggatctatgacggaattgtggattatttaaagaacttccaggcaacagaccgggatatgacaaaatacgtgatcggcactgtcagcgacatggatgtgccatatcctccatccaccaggggaaaccggggcctttccgcctatttatccggtgtggaccgggaaatgatgggaaaagagcgggaagaggtattaaatgccagtcaggaagatatcagaagcctggcgcctcttgtaaaagccgttctggatacgggaagtctctgcgtcattggcaatgaagacaaaatcggtgcggataaagagctatttggagaaaccaagaacctgttccactcataatacaaggccttacagatatacctttatgtccagaaaccaaggacatgaaagaggaacgccttacaggcatacctttatgtccagaagtcatggacatgaaagaggaaaggaaaactcacatggaaaacaattataaatcaggctttgtaaccctgatcgggcgtcccaacgttggaaaatctaccttgatgaaccatctcatcggccagaagatcgctatcacttccgataagccccagaccaccaggaacaggatccagaccgtgtatacggatgaaaggggacagatcattttccttgatactcccgggatccataaggcaaagaacaagctgggggaatatatggtaagcgttgcagagcgcaccttaagggaagtggatgtggtactctggctggttgaacccaccacctatatcggtgctggggaacagcatattgcagagcagttaaaccaggtcaaaactcctgtgattctggctatcaataaaattgataccctgaaaaatcaggaggatatcctgacctttataaacgcttataaagatgtgtgccaatttgctgaaattgtccctgtttctgctttaaaggagaaaaatacggatctcatgctggaactcatctataagtatcttccaagcggacctcagtattacgatgaggatacggtaacagaccagcccatgcgccagatatcagcggagcttatcagggaaaaggcccttcgtcttttaaatgacgagattccccatgggatcgctgtgaccattgagaagatgaaagagcggaataacggcatcatggatattgaagcagacattatctgcgagagggattcccataaggggatcatcattggaaaaggcggttccatgctcaaaaagatcggaagtgctgcccgcagggaaattgaagatctgatggatacaaaagtaaatttacagctttgggtaaaggtcaggaaggaatggcgtgacagcgagctgtatatgaagaattatggatacaatgaaaaagacatttaaaagtggtggtaggaattgagggaagttgaaaccatgatggggatggtgatccgaatgtccccggttggagaaatggataggcgccttgtgatactcacaagggaaagagggaaaattaccgcatttgccagaggtgccagaaggccggggaattcccttatggcggtaagccgcccctttgccttcgggcagttttccctgtatgaaggcagagattcctatactcttcggtcggcagagatcagcaattattttgaagcgctggccctggatatggaaggaacctgttatggttcatattttctggagctggcagattattacgcccgggagaacatggatggaacagggcttttaaagcttttataccagtccatacgggctcttttaaagccggctttgaaaaatgagctggtccagagggtctttgagctgaaagccatggtgctgaacggggaatatacggaaaaacctccccactccgtcagtgactcggcggtctatgcatgggaatacgtaatcgcctccccggcagaacacctttataccttcaccctgacggacccggttctggaagaattcggccgctgcgtagaaatcaacaaaaagcgctacgtagaccgggaattccactcccttgagattttaaaaaccatgacaggcgggaaactattgaaatgaggggggcatttggtataatgttcaagaatgctatgagcagtgcgaatcaggttacggaaaagttttcgttgtgctcgcacataagaaaacttttccgtaacctgattcatagggcgaatgcccgtgagccagtgaacacgcagggttcactggctgcacagcggactcactggctgcacagcggactcactggctgcacagcggactcactggctgcacagcggactcactggctgcacagcggactcactggctgcacagcggactcactggctgcacagcggactcactggctgcacagcggactcactggctgcacagcggactcactggctgcacagcggactcactggctgcacagcggactcactggctgcacagcggactcactggctgcacagcggactcactggctgcacagcggactcactggctgcacagcggactcactggctgcacagcggactcactggctgcacagcggactcacggcccacacaacggactcacggtccacacagcggacttcatgatccatagtaagtttcaccggccgcccagcaggctcataggcaacagtacggcggattttcaaagcaggagggaaatggatgaaaaaaaagaaagcggttctggcggctttcctggctgccggaatgctgacaggctgcttgggcagaagcggcggaggcgccttaaacggggagagcagcagaatctatgtaacgcaggaaggaacatttcagactgcgacagtggaaacctatgcggaacaggattattatcgtgcggatgaattaaaggcttatctggaagaagccgctttaaaatacaatgaaactcacggacaggaagcggtggccctggattcctgtactctggaaaaagggattgccaccatggtattccgctatgggtcaggaaatgacctggtgagctttgtttccgagtatgaggataaggaaaatcaggtaaattccattgctgttactactttgggggatgtattaggccagagtgaatcagaaggagtagcctttgtaaaggccgacggaaaaccggcagaaaaaaaggccttatccagcaaaggagaatgctttgcaatcgttgtggaggcagaccagccggtaacggtacagactcagggtaagcttttatttgtctccaacaatgtagtcataaaggatcgctataccgttcagacagcgcaaggaaagaattacatcatttttaaataagagaggttaagatcatggaaaagacaatggaaaagattgtgggacttgcaaaatcaaggggatttgtatatcctggctccgaaatttacggaggccttgccaacacctgggattacggcaacttaggcgtggaactgaaaaataatgtaaaaaaagcatggtggcagaaatttgttcaggagagtccctataatgtgggcgttgactgcgctattttaatgaattcccagacctgggtcgcttccgggcatttaggcggcttttccgatcctctgatggactgtaaagcatgtaaagagcgtttccgtgcggataagctgattgaagattatatggctgagaacaacattactatcgaaggatctgtggatgcctggtctcaggaagagatgaagaactacatcgatgagaagaacatctgctgcccaagctgcggaaagcatgattttacagatatccgtcagtttaacctgatgtttaagacattccagggagttacagaagatgccaagaatactgtatacttaagacctgagacagcacagggtattttcgtaaactttaaaaacgtccagagaacctcccgcaagaaaattccatttggaatcgcacaggtcggcaagtccttccgtaacgaaatcactcctggaaacttcacctttcgcaccagggagtttgagcagatggagctggaatttttctgtgagccggatacggatctggaatggtttgcatattggaaagaattctgcatcaattggctgaagactctgggaatcaaggatgacgagatgcgcgtcagggatcatgagaaggaagagctttccttctacagcaaggcaacctctgatattgaattcctgttcccattcggctggggtgagttatggggaattgctgacagaacagattacgacttaacccagcaccagaacacctccggacaggatctgacatattttgacgacgaaaagaaggagcggtacattccttatgttgtggagccgtctcttggagctgaccgcgtaacccttgcattcctttgcgccgcatatgacgaggaggaaatcgcagaaggagatgtgcgtacagtgcttcacttccatcctgccatagcccctgttaagatcggcgtgctgcctctttccaaaaagctgaatgaaggagcagaaaaggtgtatgaagagctctgtaaatattataactgtgaatttgatgacagaggcaatattggaaagcgctacagaagacaggatgagatcggtaccccattctgtgttacctatgattttgattcagaagaggactttgccgtgactgtgcgtgaccgcgataccatggatcaggtgagagttcctattgcagagctgaaaagctattttgaggataagttccgtttctaggatcattgctgccctataacaggcagcgatccatggaatttcttaaaaaaggtacaggatgtgaggcagattgcctcattcctgcacctttttattttttcacagctattcctctgccactgaatcggattgtttccaatgtaccgttccggaagagtgttccggaggggaatagagggaataaagctttaatggttcgtcaccggtatttacgatattgtgccaggtattggcggggatgaggacggcgcagttgtcattcacgggctgctgaaatgaaaaattataggggctgtctcccatgagcagcagcccttctccctgttctacgcggatgaactgatcctcctccgaatgattttccataccgatatctccgcccacagggatgctcatgagagtaagctgcatgtggtttccggtccagcgggtcgttcggaaggtgggatttcggatcgtatcatggacaatgttcagcaccagggggctggcccgtagtcgtttatatcccaggtaagataagtattgtccgatacgcagttagactggcaggtgtggtatttatatggcatcataggctcactcttttcatgcattgtaatgtattatatggttttgacttttccaggtgacagatattggagagaaagtatacagataacagaggatttttgtgggaagtcttttatgaaatacagtaaattgcatttccaaaacacggttttatttactgtaagcggggagatctatttatgatttagtgcgcattattttaacagtgcccgattcagattcaaaatacagtgtatttgtcgaatcatcatcgctttcaatttcagatttcacattacgagctttccacgaaagatttaagccaatatcattctgaaacatataggtaacatctccagaagtgctttttgaggtggcattcagttggctgatatcgctgctaaagtaaacggtgcattgaccgctttcagagctgttattaaattcctttgcaatgatgttttctgcttggatttctccagatttactgcttaccgataactcgttagatataatatctattaatgatattttccccgaatgagaacttatttctatctgttcagactttataccttggacttttatagctccggattttgtggcaagtaaaaatctatcaatatcgtctttatccgaaaaaataagtataacttctacttttacacttcctccgatattgggtataaagtttccttttggatgttgttcaatattcaatacaccattttgttcacccacagatatattttgaatattattcgccccacttgcagaaataccaataatagtcttgttctcatttcctttctctacaatcatttttatttccgcattttcaagactgatatcataagaaattatatcattgaattgatactggacagatttttttaaaaacacatttgttgtaacaaacaaggctaaaatgataaacccaataattgagactgcaataacgacatttttaattattctattgttcataaaaatttgattcctcctaaaattaatttgtagcgattttaatactgtatgagtaagtttcgataatatggtcaatcaatttatcaaaatgctctttattatcacaatcggttttcaatattgtacaaatactgtcaatcagagtttgagcaataatatgagcaagtctgtcatagtaagagttttcattaatcatatccgcaatggcatttgaaaaaatgcttttagtaaccatgtaagacaagaaaaccaattcttgtttcacacattgataagcggaacctgttgatccagtaaaaagtaaagacatttgtggagtaaaactttttattaagtgaatgatggtgctttcaacgccatcaaaatattcgatagaaggcccatcttctgtgtcatctcttatcgaaagtttgtttttaatgatattaatagaattttggtactctgaaaatgcaggctcaactataaattcaaatagcgcctgcttatttggatagtaacgatagatattaccaattgtcatgttggatgctttggcaatgtttctcatggatgctttttcaaatccctgctgttgaaattcatgtaacgcagctagtattaatgtatcctttatatctttttttaaaacttgcattagtaatcacctgttcatttttgatcaaggatatcacacgcttgaataaaagtcaataaaatcttataagcttttttcttatttttgctaaatggcaagcagggcaagtgtacacacacttgccaattttgagtattttcccttacggtcaaatctcaaaattgcttgttagggtagccaccccaaacccggcttttgttgcgtcatttcgctgtcgctcattccttatttgacttcgggccaagttggcccgaagtcctaaagtgcaaccagctttgcaaggtgttccaatagttttgtatactgtttccatagttcgtcatagcctttttgcagttccgtaatttcagattgataggcatttggggccgttgcatacttagcaatttgggaaaggttatttacacttcggcgttgtaaggataggagttcctttacaggcgcaaggtcaacatttacgatatatccatcaatcatcatctttcggagaaacgcactccgattttgactgttcacctctgccatgcgtttccgtatggcggctaattcttcatgtgttaccatgatatgaagccgcaaattgcgttctcttttcggcatgatatttgccctccaattcaaatatttctctctacttataaggacacaaaacaaaaaaacaagtatatcgtccacaaagaacgatacacttgtttttgacatttcacttggcagacgcccattaacagtttaagttttcatactgtcttatgacggattgccttatggattctcttttttgcggctgccttcctttgtttctacctctgtcccttatcgtaaggaataccctctgcctttggagcctgagagtttctggaggtgaagatcagcacgatcagtgtgatgatataaggcaccatcttgtagaaatagcttggaatgcctattgcgtttaagaacgggattccggaataagcggatgcaatagccttcatcagcccgaagaacagagaggcaagcatgatgttcaccggcttccactggccaaagatcaaaacggccagagccaggaatccgtatccggctacgtctgcgttaaagttggtggaggtgggaaccacaaataccagtccgccaagtcctccaagagcaccggagatcagaacgcctgcatactgcatgtggtacacattaataccggcggaatcggctgcctgtggatgctcgccgcaggcctgaagccttaaaccaaaccgggttttataaagaacaacggctgagagcacaaagatcgcaatgccgatgtaagtagtgatataagcgttctggaacaggagagggccgaagaacgggatctttcccaataccggaacagatgaaatgcggaaggtgttgctgaactgcacctgctgcacgttctggataacgcgggccacgaaaatggcaaaggcgggagcaaacatgtttaatgccgtaccgctgattacctgattggacttcatgttaatggaagcgtaggcgtggaacagggaaaacaccatgccagtggccatggagatcagcactgcaatgatgagctgaagctgcccgctcatggtgctgcctgtaaaatggatgaacaggaccccggtaaaggctcccatggtcatgattccttccaaagcaatgttgatgataccgcttcgttcggagaacatggctcctaaagctacgatcatgagaggaatcatgaaatacatggtctgctgaaaaatgaaataaactacattcatgatttcgttcctccttccttggcttcttctgcttttgcacctttttgcttctggatcttggaaataatgattttaaccataagagcaaaggcgctgaaatagatgataacagcaacgatgatatcgatgatttccgttgaaaattccagcagctgcaagtaaaaaccaccggctgtcaaataggcgataaagatgccggagaaaagaactccaatgggattgcttaagcccagcaaagcaacggaaatacctgtaaagccttctgatgccagtacgtccttgatttcaatgtgctttccggtacctgccagatacaaaagtcctcctgcaagaccggcaatggctcctgcgatcatcatggacaggatgatgctctttttttcgttgatgccggcgtatttgctggcatcccggttaaagccaactgcctttaactcataaccaaaggtggtcttgtttaaaaggatccagatcaggattaccgcaatgattgcaatgaggattcctccgtttacgctggagcctggaaatatcttatcaaggcccattttcggaatattggcagttgcggccacattccgggattcattgcgcaggttattgaataagggtttatagctttttacgatccagtttaccagatacatgccaatgtagttcatcataatggaggcaattacttcattgacgttaaaataagccttcaaaagtcccggaaccagaccccataccgcacccataataacgcttgcaagaagggccgccatccagtgggccggtcccagagaggtccaaaggatccccacatagacggcgccaaatccgcccataatgaactggccgggagtcccgatgttgaaaagccctgttttaaaagcaaatcccacggaaagaccggtcaggatgatgggcgttgcataataaaatacctgtcccacacccttagctccatgggtaaatgcgcctgttaaaattgtcgcaaatcctggaagggcctgcttgggattgcagaggaacagaatgatcaggcctacgattaatccaagcacaatggcaaagacagaagagagaatgcctgtatggtctttgatctgttttggtttcatgacttgccaccttctttctttgcgcctgccatataaagacccaattcctgaaccgtgacggccttgggatctaagtcggctgcgattccgccttcaaatatgaccagaatccggtcgcttaaattcatgacttcatctaattccagagataccaggaggatagctgctcccgcatctctttgcttaaccagctgcctgtggatgtattcaatggcccctacgtctaagcctctggtgggctgaacggccagaagaatatccggagtttttgagatttcccgtgctacgatggctttttgctgattgccccccgacatgctgcgggtagtggtaaagggaccttcactgcttctgatgtcataatcctggatcagcttttccgcatattcataaatcttgtcattttttaaaaatgtgccgctttggaaatccttttcaaaatactgctgaaggaccaggttataagccaggttataatccaggacaaggccgtgcttgtgccggtcttccggtatatgggataatccatgagtgtttttgtagcgaatgctctttttggtcatgtcttccccattgatggtaacggtaccggtgctcatgtcggaaataccggtgatggcatgaatgagctctgtctggccgttgccgtcaatgccggcgatacagacgatttcgcctcttctcaccttaaaagaaacatcatgcaccagcttctttgtctggccttcccttttggcttccacggaaagctcttttacctccagcacaacttctcccggcttggaaggattcttttcaacggttaagtttacctttcggccaaccatcatctcggacatttcttcaggcgttgtatctgccacatctaccgttccaatatatttaccgcggcgcaggacagaacagcggtccgcaaccgccttgatttcattgagcttatgggtaatgaacaggatggattttccttcctttaccaggtctctcatgatctgcatcagttcatcaatttcctggggagtaagaaccgcagtgggttcatcaaaaatcatgatttcgttgtctcgataaagcatttttaaaatttcaaccctttgctgcatgcccacggtgatatctgatataaccgcatcagggtccacgaacaatttgtatttctcgcttaaatccataacctttttacgggcgtcatccatttttagaaacccgtgctttgttgtttcaatgcccagaacaatattctggagtacagtaaaattctctaccagcttaaaatgctggtgaaccatgccaatacccaaagcattggcatctaaaggaccggtgattttttcgtctttgcctcttaccctgatcacgcctttttccggctggtacagaccgaataagacgctcataagcgtggatttccctgcaccgttttctccaagcagagcgtgtatttcgcctttctttaattgaagagtgatgtcatcattggcgatgataccaggaaattcttttgtgatgtgaagcatctcaataatgtaatccataaaatcccccttaattcggtacctatccatgggacctggttaataaaatatgccttggtatattcctgcttttatagaaaataaaaaagagatgccgtaagagaccagatctgttctgactggtgaatcaaacggcatctcctttcctcttttattgcccatgggtttcgggcgcgttacttttgcaggttattctacaaaggtgatttttgtcttttcaagctttaagtcaaccgtaggattattgttatcctgggaaggctgtaccagctcgatcttaccgtcttttaactgggtaaagaccgtatcataatcctgctgtgtgaacttggtgaatttggaagtttccattggaagtccgataccgtcgttcttagcagagaagatgctggtttttccgcctgggaaagcattgtcataaaatgcctttactccgtcgtaaacggaaacagacagctctttcatagcagaggtgataaccgtattggactcgaagctctggtcaacgtcaacgccgatcacctttgcgttcttctcttccgcagcagccataacggagttaccaaccgcgccgccgcatccgaagatcacttcggttccgttctggtaccaggaagctgccatggactgtgcttccggtgtggcagcaaatgcgcctgtgtagttgtacatgatttctatgccgtcgattcccatttcctttgccgcatagtcagcaccttctgcaaatccgtagccataacggataactgcaggaactgccataccgcctaagaaaccaagctttgtatagccgtcttttactgctgcatagccggctaagaaaccaggctcgtcttcctggaacaggataggcattacgttagcttctgtcttgaattctgaataatcggcattgtgaggttccccatccagaaggatgaaatgtacgtccttgtactgctcctgggcaagaaatacaggctcttcaaataagaatccggggcaaacaaccaatttggcgccgccttcgatggcaaggccgatggtctcaagataggaatctgtagtaccttcctgcggctggtagtacttgtaggaaatcttgttttcctccgcatactttttcatgccttcccatgcaccctggttaaaggacttatcatcaatggttcctaagtctgtaaccagtgcaagctcgtacccgttctcagacttttctgaggctgcagcggttgtctctgccgttttctcggcggcagttgtggtttccgcaggtgcggctgttgtagcgttgttgtctggtgtggaagaaccgcagccgcttaaggctgcagccatcatgactgccatagctaatgctaatgctctctttttcataatcttgtttttcctcctgttattgattaattttcagagataccattaatgtaccacattttccttccagaaacaatcatatttggtgttattttacagaaaaaatcaaaaaacaatcaagcattttatgaaatatattagtcaatcctgtgggaagggcagatctttcctggctttacctgtgatttaagaaaataaggtttagctgaaaaatgacctaaaaaatagaggctgtctgtgaagaaatgaaacttgccagaagagcagttgaagaaattatttttaaggtgtctcatgcttttcaattttctgaaaactcattgcccaatctgcacgccccactttgctgcatatttgctccagattcagcttgcagcccactacgccccttcatctggaacaaatctcccacaaagagtcacacacatcttggaacaagcagttttcagacacattctagcagtttttttgacataaaattcgtatatacgaattaaaatcgcatatcagaaaatgacagactatggaagcactttcagagtaattgtattgaaaaaagagctaatttttggtaataattaaagaaacccctttactagcgtttgaattatgctataatatctgcagggcttttttgcagatgaaaccggcagaggagctgaataaccaacacattttgaggaggaaatatacttatggcaagaaaatgggtttatttgtttaccgaaggtaatacaagcatgaaaaacctgttaggtggaaaaggcgccaatttggcagagatgacaaatttaggtcttcctgttccccagggatttaccataacaacagaggcttgtactcagtactatgaagacggcgaaaagatcaatgatgagatcatgggccagatcatggagcacattacaaagatggaagagatcaccggaaagaaattcggtgataaggaaaatcctcttctggtttctgttcgttccggtgccagagcatccatgcctggtatgatggataccatcttaaaccttggtttaaatgaagaagtagtggaagttctggctgaaaaatcaggcaatccacgctgggcatatgactgctaccgcagatttatccagatgttctccgatgtagttatggaggttggtaaaaagtattttgaagagctcatcgataagatgaaggaagaaaagggcattacagaggacgtagagttaacggctgaggatttaaaggagcttgcaaaacagttccaggatgagtacaaggaaaagatcggtgcagaattccccacagatccaaaggtacagctgatggaagccatcaaggctgttttccgttcctggaataacccaagagcaaacgtataccgccgtgacaacgatatcccttattcctggggtactgctgtaaacgttcagatgatggctttcggaaacatgggcgagacctccggtaccggcgttgcatttacacgtgacccagcaaccggtgaaaagcacctcatgggtgagttcttaatgaacgcacagggtgaggacgtagttgccggtatccgcactccgcagaagatcgaccagttaaaggatgttatgccggaagtctatgagcagtttgtaggaatctgcaacaagctggaagaccactacagagatatgcaggatatggaatttaccattgaagataaaaagctttacatgcttcagacccgtaacggcaagagaacagcaaaggctgctttaaccattgcatgcaacctggttgatgaaggcatgatctcagaggaaaaggcagttaagatgatcgatccgagaaacttggataccttactccatcctcagtttgatacggaagcattaaagaagacagaacccattggaaaggctctggcagcatctccgggagctgcatgcggtaagatcgtatttacagctgacgaagcaaaagcatggcatgaaagaggagagaaggttgttttggttcgtcttgagacctctccggaagatattgaaggaatgaaggccgctcagggtatcttaaccgtacgtggcggtatgacctcccatgcagccgttgttgcacgcggtatgggtacatgctgtgtatccggctgttctgaaatcgttatggatgaagagaacaagaaattcgttcttggaggcaaggaatatcatgaaggagacttcttatcccttgatggttctaccggaaaaatctatgacggaattattcctacagtagacgcagccattatcggtgaattcggaagaatcatggcatgggcggacaagtatagaaggctgaaagtaagaaccaatgctgatacacctgctgatgcaagaaaagccagagaactgggcgcagaaggaatcggtctttgccgtactgagcatatgttctttgaaggagacagaatcgacgcattccgtgagatgatctgctccgataccgttgaagcgagagaagctgctctggaaaagatccttcctgtacagcagggcgactttgaggcactttatgaggctctggaaggaaatcctgttaccatccgtttcttagatccgcctcttcatgagttcgttccaacagaggaagatgacattaagaagctggcagatgcacagggcaagaccgttgctcagatcaagagcatcatcgattctttacacgagttcaacccaatgatgggccatcggggctgccgtctgacagtcacctatcctgagattgcaaaaatgcagacaaaggcagtgatccgtgcagcgatcaacgtacagaaggcacatgcagactggaacgtttgcccggagatcatgatccccctgatctgcgatgagaaggaattaaagttcgttaagaagattgttgttgagactgctgatgcagaaattgctgcagcaggaagcagcttaaaatatgaagtaggaaccatgatcgagattccaagagcatgcctgaccgctgatgacattgcaaaagaggctgaattcttctgcttcggaaccaatgacttgactcagatgacctacggcttctcccgtgatgatgcaggcaagttcttagatgcttactatgataccaagatctttgagaatgatccatttgcaaaactggatcagaccggtgtgggcaagcttatggaaactgcaattaagttaggtaaggctgttcgtccggaaatgcatgttggtatctgcggtgagcacggcggagatccttcttccgtagagttctgccataagatcggtctggattatgtatcctgttctccattccgtgtgcccatcgctaagctggcagcagcacaggcagcactgaacgagaaataatctttaaatcggatttaatcaggaaaaggaatgaaataaaggcttagaatcaatggttttaagcgcagaggggtccatcagcatagctgatggacccctctgtttgttccggatagcggcagcataaaaatttactatacaacgatcagttcattctcctgctctaagtagcggcagaatacaaaaataccgcatatgatctcagggctgaattcttccggcgcttcaatattccagccgccaatgacgccacggtggaaaacattaagggtaccctgaccggacgtgtcggacagcagatagttctgactgtttatcatttgcagggagccgtaatgatcctgcagcaaaaggtcgacagaatctatacggggcattctgtaaacaggccagcctgtatcagcaggatcctggcctttggcatatttgggaaaaccggacatgagtatttcaccattgtggtttttcaaaaaatactttttagggcaggcccccttaacatgttccgttggttttaagtctgtctggatgcctgtaagaaattgctgttcttccacaaaaatctgtctttccagaccacataaacgatttttaatgtttgccagggcagggccaatggtttcctgttcccttttgtaaagaattcctgattttaaaagatatttcttcatatggcgcctcctggaaaaaactggtaacagatcagacctaatatgccggaacataccataacaactatgggatttggtttccacttccgtaatgtgaccaatgcggttaaaaagattaacacggctatccagtcagtcattgaaatggatattaccccgtcattaccccaaaaggatgaaaggagcagggacactccggcgctggcaatcatagccaccacagcaggccgcagcccggaaaggactccctgaataatagtaagtgtccggtatttataatagacaaaggccaaaagcataacaatcacacaggaagggaacacacacccaagggtcgcaaccactgcgcccccaataccgcctacctggatccccacaaaagttgctgagttgattgcaatgggaccgggggtcatttgggaaatcgtgatgatgtcgctgaactgggtcattgtcagccagggatggacctcaaccacctgatgttcaataaggggcatagcagcatagccgccgccaatgctgaacaatccgatttgaaaaaaactccagaataactctaaatagatcattctccctgcctccttgtatgccgttctctatgcaaggtatccaatgcccctgcaattccgcagattaatataattggaatcacattcaccttgaagatgcaggctgcggcaaaggcgcctaaaagcactgccagcaataaaagacgtttttcctgtaatacggaacgtgccatggtgaacaccacatcgaaaataacggcaaccacgcctgcagccatacctttcataacaaggtttactatatgattattgcgaaaggccacataaaagtatgagatgattgacaatataatcaagggaggcaataccgtaccgagtacggttacaagtgctcctaatattccggcaacgcgatagcctaccaaaatggaggcatttacggcaattgcgccgggagcggactgggcgatggccgtaagatccatcatttcatcttcctccagccaatggagcttctccacaaatttttttcgcataagcgggatgattacaaagccgccgccgaatgtaaatgaacttaattgaaatgttgaggcaaataattgccagtatattttgctttttttcattgtacttcctcctgtggcttcagtatatcacttgcagatttatattaaaaatagtattattttatcataatcataagtaatagaatatgaatcggaggtacggccatgacacttcgtcacattaaaatatttcttgcagtttgtgagaatgggaacagtgtcaccagagcggcggaggtcttatttatgacccagcctgccgtaagcctggcgctgaaagaactggaaaattattatggcgttcttctgtttgagagaatgtcaaggcagctctttatcacggaggcggggaaccagatgcgggaatatgctacccatatcctgtcattgtttgataatatggaaaaaggattgcgggattgggattcaatcggaatattgcgggtcggggccagcattaccatcgggtcacagttcatgccaagctacataagtgcttatggcgttctgcatccgggaatcgatgtgagggtctgcatcagctcgtcagatttgttagaaggtcagctgcagtccaacaagctggattttgcatttatagagggggcagttcataccccaatttgatttgtgaggaatatatggaggactccttaacagccatatgttctgtaaatgggccattctcccccggccagaaggtatccattgaacagtttaaaaagcagaggtttttattgcgtgaaaaaggcagcggcacccgggaggaatttgacagcgcgacgcaggctgagggattttcggtttttcctgtatgggaatccaccagtactactgcgctggtaaatgcggtcattcatggtttgggcattgccgttcttccgcggagaatgatattgggaccgctgaaacatggattgatccatgcttttgatgtggatgggataaatcttcagcggaagttttccattgtatatcacaaaaataaatttttaacacagtcggcccgcggatttattgatttgtgtaaaaactatgagctggactttccgattcctaaatataacggcctgtactgacaacccggtatatttgcctgaggtggaattatggaacgggaaaaaatggcaatactttttatatgatttaaattaagaagaaaaaacggaggaaacgtgtatgagaattccaaagcacatcggaattataccagacggaaaccgccgctgggccgttggaaagggaatggaaaaagaggacgggtatgacaggggaatatcacctggaatgactctttaccatctttgcaggaagctgggaataaaggaaatgactttttatgggtttacggtggataatacaaagcgcccttccattcagagagaggctttttcaaaggcatgtgtaaaggcagtggaggagctggcaaaagaagatgcggaattgctggttttgggaaagaccacatctgccatgtttccggaggagctgaagccttataccagcagacaccagttcggaagcggcgggataaaaatcaattttctggtgaattacagctgggaatgggatttgggacttcatgacggggccataggccctgctttaaaaaccgccgatgtatccaggatcgatctggtgatccggtggggagggcgcaggaggctgtccggttttttgccggtgcagtccgtttattcggatatgtatgttgttgatgatttttggccggatttcacgccccagcacgtatatgatgccattgaatggtattccaggcaggatgtgaccctgggagggtgagaggacaggcctaaggattgctgaatattgtatcaaaatagaataggtatttctaaaatttggcatactactgactgaatcatattttaatggaggtaattatgccagagacggttttagaaaaaacagaaggacgggtaagctatcatgactccgtagaagagatgctggtgagaatacgggatgacggcttatccagtgtattttccagatgggatgagcaggaaaagatacggtgcaaattttgtttgcagggattaagctgtcaattatgtaccaatggaccctgcaggctcaacgggcagaaggggccggaaaagggtgtctgcggaatcggcccggacgccatggccatgagaaatcttctcatgagaaatattatgggagcagccacctatgcccaccatgcatatgaagccttccggaccttaaaggaaacagggaagggcaatacggttttccagatcaaggatgttgataagttgaaatggatgtgtgaaaaaaccggaatcaacacaaatcaggatgtgaatcagatggctgtctgccttgcagagtttcttgatcaggaaatgaaattaggccctgatgaggaaagcgtcatggtgaaggtcttttctccgaagaaacggaaaaaggtttgggaagatttacacatttacccctccggtgtggagcatgaagttcagaacagcattgcaagctgtctgactaacgtagacggtgattacgtttccctggcaacaaaagccctgcgcttaggtttgtccacaatctacaccgctcaaatcggtctggaaatgacccaggatattttattcggaacgcccatgcctcatgaagtggatgtggatttgggaatcatggaccctgattatgtaaatatagcatttaacggacatcagccatggatcggagtcgccgctttacagatggcaaggaagcagcagtttcaggatctggccaaacaggccggggcaaaggggatccatattgtggggtccattgaaacagggcaggaaatgctccagagatttgaagtggatgatgtatttgtaggccttatgggaaactggctggccattgagccgtttttggcaacagggactgtggacgcatttgtcatggaggagaactgttctccgccggccattgaccagtatgcggaaaaataccaggttgccctggtgagtgtcagcacgatcatcggagttccaggtacagaacacaaaatgccttattatcccaagaaggcagaagagatggcggaaaaatgcatccacattgccattgataattttaagaaacggcataagcaaatcaagccaatggtgccaaaatacaaacaaaaggccatagccggattttccacggaagcggtgctgggcgctataggaaatgatttaaataatctggtggatgtgattgcaaaaggccagttaaagggaattgtggccttagctaactgctccacattaagaaacggaccccaggattggaatacggtgaatttagcaaaggaactgattaaaaaggacatcctggtggtggcaggaggctgtggaaaccatgggctggaagttgctggaatgtgcaatttagatgccattgatcaggcaggagaaggcttgcagggagtgtgcagagcacttgggatccccccggtgttaagctttggaacctgtacggatacaggaaggatgtcaatgcttgtaacggccctggctgatcatttagatgctgacatttccgatctgccgattgcggtaacagcgccggaatggatggaacaaaaggcgaccatagacggcttgtttgcagtagcatatggagcttatacccatctgtccccaacaccctttatcaccggcgcgccagaacttgtgaaattattcacagaggatgtggagggcttaaccggaggaaaagtggctttgggagatgacccggtgcaggtggcaaaggatattgaagatcatatcatgaaaaagagaaagaaaatgggtctgagttagatttccggcaggaaaagaaatgccctggaagataaaaggtcaggctttgaggaaagaaggcccggcggattttgccgaagccttcttttgctgcggataccctttaagtgattttagaaaagtccggataaacaaagcggaattgatgttcagccaccatgttcacatccttggtctgctggaaacagggctgtatttccccttgttcagcaaagtaattacaaaagttcacggtaaacagctttgaaagtatatatccggcaagatcggctgacaatgtgttttttacagcgataaaagaaggaacggttaaggccccctctttcggataccggagtgaaagcagtgtttcatctgcccggaaagcgaagatggagggggtgattgccgcaggagtgagccctttttggacacttagaagagactgaaccggcatatccaggatcgcggcattctccaaaaacaagtccgtaaactctttgccgtacagccaggtgagctgctttatcacaccccgtccggctgagtttgcctttcctccaaacgccttgggatatagggccagctctttaagggcctcaggcaaaggctgaccggccaataactgtttgttgaataccataacaagggggatcactaaaaaaggaagaaggcgcttgtcctgacagagattggtgtttttgatctccttttttaatggaaataagtcctgtattttcagcagttcttttttaaacaaaccatagatttccggatcctcaaacacctctaaatcagtggagactatgatgtccggtgcgatcccggtgttttttacctcttctgacagctttttcggatatcccagaccaaaatattctgtttccagctggatatcctgttctttcagaagggctgtcacttcttctatatgtttcttttcataccggtggaggacacagatattattccagtacatacttattttacgcataattcaccgattctcatctttctttgcatttctgcaatatattgctggtatgtatgcaggcgttcccaggtttcctgttctttttcatttcgttggatcaccgactgtattccgccgtttttcatacagatccggcagtcactcattaaggctgtgtggggatcgtgtgtggcgatcagtaccagtttctgcttttttaacagcagatgcaaggctttctctttgtgaatgccggcattttccacttcgtcaatcagaacaatgggactttcgcacaaaacggccacatcagcgatcatcagggcgcggctttggcctccgcttaaaagatttaagctgtcttctttatgtaaatgttccggagtaatggtattggcatggtcaatgacttccggaagaaccctatgccagtcccgctgcctgcaggtgcagtgcattcggataaattcctctaccgtcacatccagtacgaagcgcatattctggcttaaatgggcgatcagctgcctggatgtgtgaaagcggtcttgtctttccggcagttttccgttgatccatacatgccgtccggtgaccgtgtcgccgcaggccagctgttccaaatcctgaatcagccggctttttcctgaaccggtatggcctaccactgcgtacagctgtccaggcttcatggttaagggaaaagaagcttccggctgtccgtttttattgctgccgggtataattgtcagttcatgaaacacggggcacctccttaaaatccattttttccacaacgccatgctgatacatggtgccgatccgcttttctcccacacagtaagagcagacaccggcaggcatggtgtgacgcagggtatcattgctgttccagcccgtttcaggaaggctttctaaatactgaaagagaagtccgctgccgtaaccggataatccgtctacaggaaagatatgagcagttggatttaaggagctgatattataatggataatttctttttctgcctgggaaaccatatcgattttggtcatgagaatgatatcggcggttgtcagcattggcccaagctttttaggggaacgcaggctgctggtacaatctgtcacgcagatgctgaccgtgtgaacggtggcaggggaacagcggttacaaagtccggcagtttcgatgattaaatattccgtttcctgcagttcattccaggcgatcatttcctccagatttgaaaccaggaaatgatccgggcatatgtcaccggacagaccaagtataaacggaacacccagagcctcataggcagccggatcatcggaatgcagacagtcgatcttgcagacagaggagcgcttgccggcggactgaatatgccggatcagatttgtggcggccagggttttgccggaggcagagccgccgctaatgagaattattttacttttcattttttccgtctccttgtataataatggtatttccaacgtattatagcagactgatgaagaaggaggtgtctcatgtgacacaacgggaaaaggacctggaatttttaaaaaccacagaattattccggggaatgaatgtgggggacatggagtttggtatgtgcagcttaaaaaaaggcagccttgtgagcaaccgctacatgggagagaaatccatcggcattgtggtaacaggcgagatcgctgtttcatcggttactcaggacgggaaggaattaaccatgaaacggatttatcccaaagactgtttcggcatctgcacgatttttactcatgccgagatgcccaacacactccagtgcatgtgccacacaaccgtactgtacataaagaaaagcgaacttttgaaggtgtttaaaagggatccggagctgatgcttcatatcatgacgatctttaacaaaaaaatcctgtttctgcagaagaaaatcgaaatgcttaataccacctctgcaaaggcccgcctggcagattatttagtgagtcacgccaacagcaatggggtgattttcctgcgcacaggcaagaccgggttgtgctccagcctgggaatcagccgtgcaaccctgtatcgggagctggacagcttccggctttcaaaagccattgagtatacggatcagaagattgtgatcagggatgtatctcatttgagacagttttccaggcatcatcttgactcccaggcagcttcatgttagtatgcagaggttagttgatactaactaaaagcgacctaaggagagttatatatgttaaaaatagcggtatacgggaagggaggaattggcaagagcacgaccacctcaaacctggcagcagcattgtctgacatgggataccgggtgatgcagatcggatgtgacccgaaagcagactccacacagaatctcacattgggaaagccggtaaagacggttttggatgcgattaaggaaaagtctgatcatgtggagctttcggatattgtatttcccggctacaacggggtgttatgtgtggaagccggaggcccgactccaggaataggctgtgccgggcgggggattattaccgcttttgagcggttggaagcgctgaatgcttatgagatatacaagccggatatcgtactttatgatgttcttggcgatgtggtatgcggaggcttcgccatgcccattcgcggcggctatgcggagcatgtatttgtcgttacttcgggtgagaagatgtccctttatgcggctgccaatattgtcagtgctgtgggacagttttcaaagaggggatatgcccggtattcaggtatcattttaaactcaaggaatattgaaaaagagcaggaactggtatcagaatttgcagaggaaagcggcgggaagatcgtgcggattctgcccagggatggagtggtacaggaggcagagaaccagaaaaaaacagtggtggaagcatttccccacagtgccatggcaggagaataccgttccctggccaaatccattctggaggtgtgtggtcatgaaaattgattgcagtacgcttcattatacatcgcctgcccacggcgggtggggagtagtccgtctggggatgctggttccggaaagttaccagctgtttgtctgcccttttgcctgtggaaggcatggggccctgggagcaatcggccatggtttaaaagaccgcctttcctatttatacattgatgaaagtgacattgtatcgggaggatacgaggatctgattccggaagcggtggcagagcttttagatactctggagaaacggcctaaggttctgatgatctttgtcagctgcctggatgacttactgggaacagaccatgagtccatactggaggtgctgagggaacagcacgaagatgtccggtttactttctgccatatgaatcccatcaccctggatacggataatccgccgccggtcaatatccgccggaaaatgtacggcctcctggaaccgcgggaaagtaaaaaaagccaggtaaacctcattggaaatccggtgcagatcaggccggaatccgaattgtttgggtttttacaggccctgggagtggaacaagtcaaccatattgcacagtttgaaacctttgaagcataccagcatatggcggctgcaaaatggaacctggtggtagcccctccggcagtgaaagcggccatggacatgaaagcccggctgaatattgattttgagttagtctacactaactatcgggaagaagatattctgaacacctataaacggctgatggaaaagctggctgacaaagaggaggtcaagtttgatctggaacaataccaaaggaaggcaaggcaggctgtcagggaagcgagagaggcagtgggggacagaccggtttttattgattacacggctgtggtttttccttttgcagcagccagggcattgtgtgaggcaggattctatgttgccggcatttttgcccagacagcccagggagcagaaaaggaacatgcagactggatccatgaacatatgccggaaattcaggttttaaatcccattgcacatgatattcccactaagatcggcacatttccaaaggacagccttgccattggctttgaagcagcctatattacccgtgcccgccatgtgtatggtctggtaaacaatgaagggaactttggatttgacggtttggtccggttgatggaaggaatcgtccatggggttcaaagggaagaagatctagaaacgctgataaaaaattatgggttggtgatataatgcataaactttcgatacaactgcctccctttgctcctgattattccggtgtatgttccgcactgtttgcccttggcggcttactggtgattcatgatgcttccggctgtacaggaaattataccggctatgatgaaccgagatggtatgattcacgcagtctggtgtactgttcaggactcagggaaatggatgcgatccttggcaatgatgaaaaatttatacaaaagatagaaaatgccgcaaatgatttaaagccgaattttatttgctttctgggaagccctgctcccatggtcattggtactgatttagaaggaattgcggcagagctggaagaacgtacggggattccttccatgggacttgccacaaccggtttgcattactatgataaagggatttctgatgcttacatagcttttgggaaaaagttctttccgccgccccaggcagcttgcccgtccgggaaccgtgtcaatattctgggactgacaccccttgatttttccaacaacagcaatgcggctgacttaatcggcgagctggagaaacggggtcttaccattcaggctgatttttccatgatatctgatttccataaggtttgccaggcaccgtctgccggtgtaaacctggtggtgtcaaaaagcgggctgggcctggcagaatatatgaaaaaacggtatcagattccttacgtggcgggagtgcctgttggggaatcaggagctgaccgtctggccggaatgctgaaagaaacaattgcagacaaacgggagcgggcactggaaacggatggagaagaaacaagtcaggttctgatgatcggtgaagaggtgttgatccggtcactggcgttttatttccgagaagagaggggaataaggggaattcagccggctgttttatttggtaggacacagggagtgtaccggcaggacagccttgcattaaacagcgaaagcgatatccggaaactggtgaacagcggaaaataccataccattatagctgatccgctgatctggcagctgatccgggaaaaagaaaagatacaattcatggatctgcctcatgtggcggtttccagcaaggtatgctgggaccatgtgccgcagctgatgggaggacgattgactgaaagctcatttgctcatgggctcgaaggttgaattccaagcaggaaccacaggttcatgatacaagaagggagaattgaaaaaatgaaaaagacagtaacgcgtgtattaagcctggttctgtgtatggccgtattatccggctgcacggccaagacggcttccacagagactacggcaccaggcacagaggcggccgcagcagaaaccgcacccgaggcagggaaagaagaggaaaccacaccggcagccggagagaccaaaacgatcattgaccatggcggcaacgaagtggtgatacctgctgatattgaacgtgtggcaattgcatccttgtggccgctgccatcggtttatgtattgtatcagggttcaggagccaagctggtgggcatgcatccggcttctaaaagtgcggcagaacattctcttttaatgaaggtggctccggagttaaaggatgtggatacttcctttgttcagggcggcgagatcaatgtggaagaactcattaaactgaagccggatgtgatcttttgcaacgccaacaatgcaaaagaaagggacgtgctgttaaagaccggtattccggtggttggcttcagcacttccatagccgggtttaatacggtggaaactgtaaacaaatgggttgagctgctgggagaagtatttgatgagccggataaagtggctggtattacggaatacggacgtgaagtggccgctgatattgaaaagcgattaaaagacgtaaaagaggaagacaagcccaaggtgatgatgatctatcattataaagacggggtgttccagacctccggcaaccagttcttcggacagtactggtgcgatgccacaggagcggtcagcgtatcaaaggatattccaggatcaggcgtggatttaaccatggagcagatctatgagtgggatccggatattatctacgtaacaaacttcagcccatacctgcctcaggatttctatgacaacagcattgaagggtttgactggagtccggttaaggccgtacgggaacacaaggtttataaattccctctgggaatgtaccgctggttcccgccgtcctctgactcttccttgtgcctttactggatggcccagaaaaatcacccggaagcttttgcagatcttgatttgaaccagacaattaaagatttttatctgaagttttataatgtggagctgacggatgaagaggtggaaggcatgttcaatcctccccgtgaagcagcggacggagtataagcatgttgatgaaacgatatggagccggaatcaggatcttactgatcctggctccggtattaacggccctgatctgtctgggcatcggacgctattcttttaacctgattgacatttgtaagctgttatatacctatgctgtttccggaaaggagacaattgagccccaggcatacagtgttgtattcaatatccggctgccgaggatcattctggcggttctttgcggagcgggcctggctgtctcaggagcggcatttcagcccttattttccaatgcgctggcgactcccgacaccctgggtgtggcacagggagcatgtttcggtgcggcaatggcccttttattttcagacagccttttatgggttcagctggtggccctggtatttggcctgattgccattatgctcacttattccatcagcaaggtcaaaggtcaatcttccacatttatgatcattctggcgggaattgcggtttcttctctttttacttctctggtatcgctggttaaatacgtggctgatccggagtctcagctgccgacaattacctactggctgctgggaagtatggccggaattacctacaagagtctggccattggcggtcccctgatctgcggcgggatattgatgatctatctgctgcgctggcggctgaatattctgtcaatgtctgaggatgaggcaagatccatgggaattgacttaaaaaagcttcgcatcatcattattctggcagcggcattgattacggcttcctgtgcctccatgtgcggacggattgagtgggtgggactgttaattccccatggggtccggatgctgtttggaagcaataatgaacgggtcattccggccagcatcagcctgggcgcagtatttatgctggttatggataccactgccagggctgcgaccactgctgaaattcccttgtcaatcctgacagcagtcatcggagcgccggtatttattctattgctgagaaagacaggaggaggatggctgtgatttttgaagtgaagaaaggatgctttggatataaggcgggggaagaaatattaaaagaaattacattccggcttcaggatggagaggttctggcagtcctggggcctaacggtgtgggaaaaaccacactgcttcgaaatatgatgggtctgctgaaatggaaatcagggggaagctatctggatggaacatgtctggcaaatatgcctgtaaaagatatctggcagaccattgcatatgtccctcaggcaaaagcatcccttttttcctatacggtggaagagatggttttactggggcgcagtgcccacatcgggaacttcagccgccctaaaaaggcggatgtggaaattgccgacgaggcgatccggagtgtgggaattgattatttaagaggaaagctggtgagccggatcagcggcggagagctgcagatggttttaattgccagggccttaactgccaagccccggatgctggtgctggatgagccggaaagcaatctggactttaaaaaccagctgattattctggataccatccggcggctggcggatgaaaagaacatatcctgtatttttaatacccattatccggcacatgcgctgaagatctctgataaggcgctgattttgaaccgcagcgggaaaagcatattcggcaaagtggatgatgtggtgacaaaggaacatatggaagaggcatttggcgtaaaagtcctgatcagtgaaatagaagaggaaggccaccgctttaaatccgtaacagccctggcgttaacgtaagcagctgaggtgggcgcgggcttttccttgaaaaatccccgcacaaatcagaccaaggccccggcaattttgccggggccttctttttgtaccgggctgactgaaaatcttatccttatttataaattatgttataatacaaaaatgagaataaaattggaagaatttaccgaatcaagtaaaagatggattggaaatatccgcttgaccaaggggggaataggcttgatcaaatatttggtaaacagataccggagctggggaattgcaaaaaagacactgatcatcctgctttttgtctccattgtccctgtcatggtaattgaaatcataacctgtgtcattgcggcaaacaccttaaaaaagcagatggatattctggtggaaagcaatatgaaattatcccagaaagggctggaggatttcttttccgaatatgacagcatcatcatgtccatttatacggaaaatgaatacgccgtaaagctggaaaagctgaatgtgtgggattccaggaattattatctgctgaaaaagcagctggaggatgatctggaaaacatctcttatctccacccggaaatattggggatcgcggtggtgaccctgaaaaaggaatgcatcctatatgattccatcacaaacagcaccatggacagctactgctttccggaaaaggacaagagctggctgaatttgactgatgagacctttcacaatacccggaccgtttattccggtgtcataagccgggaagaggcgggcggcaaaaaaagaaacatcttgtatctggggcaccggatcgcggatatcaacaattacagacaggggactgttggaagtattttgatctgccttgacgagaccaatatacgggaaacctattcccaggaaaatgaaaacgaggtcaatgtttccttcctctgtgacggcggcggaaacatcatttccagcaccagggcagacttgatcggaacgggcatttttgatggattggatggcagcaaaggggagctgttttcccagacggacgcaaagatccgtcaggctgtggaagcccgtcagatcatgaaaagtaagtcttacagcatttacacaaagcctgtgatgaaagatcagtttgtgctggtcagcatccgggataacaaggagcctttgaaggattttaaatacatctttgaagtgatcatcctgcttaccattctgattatcattaccagcgttcttattatgatccagtttgcaggctctctacaggtctgcgtggaaaagataacctctgccatggacagggcttataagggagattatacggttcagatccggcatacctggcaggacgagtttggaaagatcgcaaagcattttaatcacatggtacaaaagatcgaccagtcgggaaagatagaaaaggaagccctgcttcgtgagaaaaacgcggaattaaaggctttggaagctcagatcaacccgcatttcttatacaataccttagatgccatcaactggatcgccatagaaaatgaacagttcctcatcagtaaaatgcttaaaaaccttgccaccatcctgcgttacagcgtacataaaagcaatggtgtggtcagtgtgagaagcgagatggaatatttaaagcagtatatttttcttcagcagcaaaggttttccttttcctttcactgcatcatggatgtggatgaagaggttctggatttaaaaatgcacaagcttttgttccagcctttgattgaaaatgccatcattcacggatttccaggcaatacagggcaggatgagatcaccatttccatcagaaaaaagggagataagcatctggtggtctgtgtggaggataatgggaagggcatggatgaggagcttgtcagggaactgaaccactatgattatttaagcggaaccatggaagggagcatcggagtgcggaatgtgatcatgaggatcaaatattattatggggaggaggggcatttcttcattgaatcagatgacaggggaacgaaaataacggcagagattttatttgaagaatagacagggggatttataaagcggtatgagagttgtaattgtggaagatgagccaaacaccagaaacgggatcataaagatcattgaaaagtacacaccccatgaagtggttgcaggggaaagcgatggagaggcgggccttgaaacggtactatccttacggcctgatgttgttataacggatatcaatatgccaaagatggacgggctgaccatggtcaataagatccgggaagcgggaagtttaacagcggcaatcctgcttacagggtattcggagtttgaatatgcccagcgggccatacagctgtcggttatggaatatttgctgaagcctttggatgtggaggatattatggaggtccttgggaccgtagaagagaggatctcaaagaacaaggtggaaaaggtatcggcggaacagcttttattttcccttctgacagggatgaaaatgatcaggaaatggttcaaaggcaattggccgaaaggataaggaatcaaaaggaccaggtcatttccatgttcctgatccagtcggaaagcatactggaggatacgacggcacagatggcagaagtccttaaggacagccttgatgccatctgcctcacaggcttttttatcttcaagcttccctatgagaagcagatcctggtcatgatctccgacggccagaacgttaagtatttaaagtccatatttaaaacccagattttaaaggaactgaaaaagaaaggggaatttctcatcagctacggggaactgaaaagtctctccatgctgaaagataccttaaagcagatgcaggaatacctttcctatgcctttgtgtttcccgacagctgcatcatcgacggccagctgatccaggatttgtcctttgaaaaggtggagtatccggagtatttggaacggggataaaaagggacatcagaaacggaaataaggaagggattaaaagaaacgccaggaaatttgaggaggctgtcattgaaagcagggaagagccaagtgtggtcaagaaccataccgtccgttttgtcatggcggccttaaacactgcaagggatttaatgaaaaacaaagacattgaggccctttaccaatacttgttaaacgatatgatgaaaaccagcatcagggaaaactttttaaataactactggaagatgatggatatggtggcagatgacaaggaaacggctgctttgaccggcaatggcatgattttaaatgtcatagaattcatcaggcagaattatgataaagaaatttccctttccgatgcggctgatctggtgggcattacaccggaatatttaagcaagctgttcaccagggaaatgggaatcaacttctgcacctttttaggggaattccgtatcagcattgcaaaaaagcttctggcaaccggcaattataagatccacgaggtagctgaaatggtggggtaccgggataccaagtatttcaacaaggtatttcgttccattatgggagtgtctccctcagactacagaaaggtgttttagattatgaacaggaccgtacaaagacttctgatcggtttatggctgctggtttcctgtttactcatcagtgtgatcgtcaagtattacagggaatccaacgagacggcagcggcggaggagaaaagggaccagcttgtgatcatggccgtctgcgaggaagacgaaagcgggaaatacttaaaagagcttgtggatgaatattcccaaatgccgggaaacccggaagtcaggatccagtatgtttcccaatccggctttcaaaagcagctttgtcttgataaggatcagaatacccttcccgatctgatcatctgcgaaaacgtcatgacccctgccctggaatccatgggcatactcagagatttatccggctatatgacagcagacaggacaaccctgtatttaaagaatgcttacagcagtacggtggtaaacggcgtctgctatgcggttccctttaccagcaacccctatgtggtattttataatgaggatcatttgaaaaagtacggcgcttccatacctgaagatatggaagggttttataagctgtgcagggaaaccaatacccttggcacctataatttcggcattgccatgaaaaataaagaggacattacttccagctttttacagatgatctattccgccggagggactttacggagcctggatacggaaaactgcatgcagctctacgagatgctgggaaatatgagggatgagggcatcatggcccaggatgtgatcaactggaaccagaaggacttaatgaaggcgttttcaaggggatatgtgaaaatcgccatagcagagttaagctccatgtccatactggagaattcagataaaaagagcccgtacaggatcgcggagattccctatatccagaaacagacctatttgctccagggagacaacataggaatcactgccacagcggactggaacgagtccataaagcttctggattacttaacttccagggaggtcataaaaagctattacgaaaacaccttctgtctttccgtgaggaccgatttaacggtgaatccgggactggaaaaaggtcttacggatgagtttgtggaaagagagaggaaccagagcattttaaagaatgcctactccacatggtttatcatatcagacgggattgcagggaacttaacggattttttcggggataagaccatttcgccggaggaggttgccaaaaggctttcagtggacatcaggaatgccattatggaaagataaacgaaagattaaaattataccccttttctaaaattttggaatactccgtgaaaccgacttatgctatcatctgcttaacagtaaaaataccttacaggtatacctttattcccgggaagaccgggaagtgaataggagatgggaggttttatgaagagaatgaagaaactcacgttggcagcgcttgcgtcggccatggctctttccctggcagcgtgtcagggttccgggacaaatacggaaacagcggccccggacaagacagaaacagcttccggggaaaccggaaaaacagcagacacccagggggcaggcggaaagacgaaaatttccattaccttccgggatgggggaagcgatacgttaaagaactggtttgaaaacgcatatgagacttacgataaaaaggattccattgaacttgacattgccccgatcactgcctcggaaggagattactttgcaaaggtggccctggcgctccagtcggcggatacggctcctgacattgtctgcgaagatacgttccagcttccttcggacgtggcggccggttatcttacggatctttcttcttacttaaaggattataaggaatggagtgacggaaccttctacgggcctttggtggatggtgttacatatgctgacggaagtgtttacggagttccctattgtacggatacccgggggctttggtacaacaaggaagtatttcaggcagccggtttggatacgcagtggcagccgaaaacatggcaggaggtcttagacacctgtaagatcatcaaggagaaatgcccggatgtggtacccttctggtgcaactcaggagtagccaccggagaagccacttccatgcagacttatgaaatgcttctttacggaaccggtgagcagcttttggatgagaatgacaaatggatcgtatccagtgaaaatattttaaagtccttaaactttatcagcaccatttataaagagggatacgggccttccttatccaaggtattaaacggagaagcaggaaacatcgcttccagagagtacttaccaggaggcaagcttgccatctccctagacggatattggatgaccggaaactacaaggatacaggggccgctccatggccggaatacgaggagaagctgggcattgcagccatgcccacctccgagggacaggaaccgggaagcgttaccatgtcaggcggctgggccttatccattccccagctttctgatcagaaggatgctgccatggactttatcaagcactgcatgagctatgatgtgtacttagataccatcattgcccagggtaatattgcaaccaggaccgatattgcgaaagattccacctacgcctcccagccattcatggaaaagtgcaccggcttcctgtcaggagccttttaccggccgagaaacagccagtattccacggtcaccacacatatccagaccatggtagaatcggttgtatcaggaaacagcccggaggatgcaatggcacaatataaatcagacgtgaccaacagcgttggtgcagaaaataccgtggaaaaataaacattcaggatttaaaggggagggcaaacgtgcaacagcaaagcacctggccctccctgattctatcctaaaggaggagataaagaccatgaataaaaaaaacagccggttgtttgcggaagcaaagaaatcggtattgatcctgccctctatggtccttttgctggtgttttttgtgacgccgattttattgaccatttattattcctttacaaacctggccttgtcaggggaaaatgcaaagcagcttaaattcatcggcctgtccaattatgtcagcatgttcaaagaccgtaccgtgcggatcagcattgcaaatacccttgtttttctccttggaagcctggtcgggcagcaggtgctgggatttttcatcgcccttaacatgaggaacagaaacaggattttccgggggatcacaggccctatttttctggcaggctggatcatgccggaggtggtggtggccttgtgctgcagcacctttttcggagatgaaggcaccttaaaccagatcttttcttttttccatctgcccaccgtggaatttctgtttgccatccccatggcaacggtaattctggcaaatatatggcatggaaccgcattttccatgatgaactttcagtcggccttagatggggttccggcggatattgaggaagctgcaagagtggatggggccggccctgcccagaccatgctccggatcatccttccctgtatcaaaaataccattgccacaaataccatgctgaataccctttccacccttggcgtattcggcctgatctatatgatgacaggaggagggcctggaacaaaaaccctgaccctgcctattttcatgtaccggcaggcatttatttcccagcagctggggtacggaacggctatttccatgatcctgcttgtgatcgggatcgtgctcagtgttttctatacaagagtcatgagaaaggattagaggaggtgcttcatgtattggaaattcagaaaaacggtgccctatggggtactgaccatacttgccattatttttgttcttccgctgctctggatcgtgcttgcctcctttgacggcaatgcctcccaggcggttaaggtgcctgcccagtggaccttaaaaaactacagggaaatcctgtccagccggaccaaccagcgggcatttgccaacggattgtttatttctttcggacagtcccttctggtggtgttccttgcaggtctggcggcttatcctttatcaagatatgagcttcgttataaaagcctgtttttatatacgattttatttatgacctcccttcccattacggcggtcatggttccggtgtataagatgtttttaaccatcggcctgtacgacaagactctggggcttattttgtttttaacggccacttccatgccttatgggatctggctcatgaaaaattttatggacaatgtccctattgaattagaagaggcagcctgggtagacggtgcctccaccttagacagcatccggaaaatcatcgctcccttaatgtttccgggaatctgtgtggtgttcatctttaccttttcaggaagctggggcaattttttcataccatatatcctgctgcagacactgaataaattaccggcttccgttaccctataccaatttttcggtcagcatggtatgataatatacggacagttagccgcatactctgctgtctatgccattccttccattttactttatattttatcgcaaaactatatgtcaaagggctttaatatggccggtgcagccaaaggctgacacaaaaggaggagattacaatgatactgatcaaagaacggattggaaaactggtggaggacttaaaaggtttgatctatgccaggaaagtacccgtcacaagctaccggatgttaaaatcaggggaacgctttttaagtctccaggaccttcctgcccatggctgggaagagcttaccaacacagagctgtggggcgggcacagggaatatttctggtttgaaacagtcattaccattccaggggagtttcaggatgaatgtgtggtatatgagttgaaaacaggtagagaagggctgtgggatgccaccaatccccagtttaccatttatgtcaacggtgtgagacggcaggggcttgatgtgaatcacagagagatcatattgacggaaaaggcagcggcaggagaatcatatcaaatcgttttatccgcatttaccggggatcagaattttaagctcgttatggattccatgatcaaggtgctggaccgggaaacggagcagtattattatgatatttccgttccctatcaggtggccagactccttcctgacagtgacagcgcttatctttccatcattcacgcggtcaatgaatccttaaacctcctggatttaagaaaggagtattctcaggaatattatgaaagcctgaaaagggccgggaagtacatgagagaagaattttatgacaaatactgcgggaatgagggggaaacggtttactgcgtaggccatacccatattgacgtggcctggctgtggacccttgcggttacggaggataaggctgtaagaagcttttccacggtgctggagctgatgaagcgttacccggaataccttttcatgtcaagccagccccagctttataagtatgtaaagaaacatgctcctgaaatttatgaggagatccggcagcgggtcgcggaaggaagatgggagacggaaggcggcatgtttgtggaagcggactgcaatttatcttcaggagaatctcttgtgcgccagttccttcacggcaaggaatttttcagggaagaattcgggaaagacaatgagattttgtggcttcccgatgtattcggatattccgcagcccttccccagatcatgaaaaaatgcggcatcaaatattttatgacaacaaagatcagctggaatgaattcaacaaaatgccctatgatacctttgaatgggaaggaattgacgggaccaggatcctgactcatttcagcccgagccgtgactataataaggcggctgaagaagggggtacggagaccgagcatttcaccacctataacgcatacataaacccctcccaagtaaaaggcgcctgggccagatacagccagaagtatttaaatgatgaggtcttaatgtcctttggctacggagacggcggaggcggaccaaccaaagacatgctggaaaaccagcggaggctggaaaaggggattccaggctgcccaaggacccagatgaccacttccagagcattttttgaaaaactggatcaagaggtgagagggaaaaaatacctgccttcctgggtgggagaattgtacttggaataccacaggggcacttatacctccatggcaagaaataagaagtacaaccggaaatcagagtttttatttgagaatgcagaattttactccatgcttgacggcgtattaaaccagaatccctatccggtcgaggcaattgaggaggcatgggaagtgatcttaagaaaccagttccatgatatccttcccggatcttccattaaggaggtctatgaggactccaaaaaggaatatgaagcaattggagcggtcggaacagaattggttggcaatgcactttccaatgtggcggaacgtattgcagcccataaagagagccttgtggtatttaaccccaacagctttgaaggggaaggagccgtatcctttaaggctccggagcatatggaaaacctggcggtaatgtctggagagcttatgctgcctgcacaaaaggcggatgatggttcctggctgttttgtgcttcccagattccttctaagggctacaagacctttgaactgcgggaagggcgatgtgatacgggcttaaaggcagatgagagacatctggaaaatgagctgatccgtgtaaccttccatgagaatggacagatttcttctatttatgataagcagaatgaacgggaagtgctgaaagaaaacaagtgcgccaacgtgcttatgacttatgaagacagacctcataactatgatgcctgggatgtgaacaattattatgtggaaaaatcctgggagatcaccgatgtaagcgctatggaacttgtggaaaacggcccggtccgcgctactttatgtgtaaagagaaaatatctggattccaccattgaacagtatatctccctgttatacaacagccctgaaatcattatacgtaatgaaatcgactggaaggaaaaccacatcttcttaaagtccattttcccggtggatatccatacggacgaagccacctttgagatccaatatggaaatgtaaagaggaaaacccattacaataccatgtgggattatgcaaaattcgaggtatgcatgcataagtggatcgatgtttccgaggatgattacggagtcagcatgatgaatgactgcaagtacggctgccacgtccataacggagaaatgggcatctccatgctaaagtcagcgacctatccaaacccggatgctgacaaggaacaccacagctttgtattttccatctatccccataagggcgactggaaaaaggcaaagacaattcaaaaggcctatcacttaaacaaccctatgacagctcttttgaaagagacagagggagggcagctgcccggagaattttctctggtaaaagcggatgccggcaacgttgtcattgaggttgtgaagcagtcccgaaaagggaatgaaatgattcttcgcttttatgagacaaacaaccggcgtaccagcgggtatatgacctttggcatggacattcagagaattacggaatgcagcatgctggaggaggatgaaaaccaggtggattgtcaggacagaacagcttcttttgtgattcacccttatgagatcaaaacatggaaggttacgttccggtaatctttttcaggctgaagcagcagactttttcaagtctctgctttagcctttttcaataaattcttgttgacggattgtctgatgggtatgaaaaaaatagaaaaaatcatgtttatgtttgcagttttcttcaaatgtgatacaatgattgtatgacatcatgaaatattaatgcgaaagatgaatatgaagaagagggagtgagacatatgggagaggtttccaggattcctatcgtgcagcaggtggtaaacagtatgaaggaatatcttgcagcagacggaatagatgttggacaaaaattacctacggaaaaagaatggtgtgagaagctgactgtgggacgcggtacggtcagagaagctttccgcattttagaggcccggggactggtggagatcaaacctggacgggggcattcctggtcagtaaaaaagagcttggacaggaagaactggcggaatggttccttaaaaatgaagtggaattaaaggattatattgaggtccggagtgccgtagagcctttatgcgccaggatcgtggcaaagcgggccactgacggggagcttgaacagattgaacggatccatttccggtttatccgggcagtagaggaagaggacattgccggaatggcaaaatacgatgaaaagctgcatcggcagatcgtggaagccagcaaaaacaagatgctgatttttatgagcaaaaagatcgacgaatgcatccgggatttccggttaaaaacgttccaggtgccccagaatgcccggaacgccataaaagcccataacaatattgtagaagctttaaaagcacgggacgaagaggtgtcagagctttatgcaaagagacatatctctctgatcaacacggatctggatgtgatcattaagcggtaggcaatcgaaagagcagcagcagaacgaaaggaaggagatcgttctgctgctgctcttttgattggaaaagctggaaaatagaagagtggtaatacaattttgaaaggggtgtgtaggacagtcttttgttaaatttgcataattttaaaaattctattgacaaaattcgataaaaaatgtattatttagttgcgatattgtatgacagcagacaaaaatgcaaacccgggaaggcaaataagaatgatatcatacaatggtttaaacatttgtaacaaaaactagggtataaaaacagaaacaaattcaaaagtatgctacaaaagaatgaaaaaatgttgagaggtggattattatgagaaaagttactgcaattgtattatcagccatgatggcattgtctttaagcgcttgcggttcttctgcaaaggaaactactgcagtggaaaccacatcagccgttgcaggagttgaaacaaccgcggggaaaacagaggatacaaaagaaccgattaaaatcggcgtttctgcaccggatttgaccaatgtgttcttcatccagatcaaggatgcgatgcaggcggccttgaccggaccggaagatgaactgatcattcaggatgcagggggcgaccagaataagcagatgaatgacgtagctgatatgatcaatcagggcgttgatgtaatttgtatctctgcaatcaactcagaaggagtacgtgccactctggaagcatgtaaggaagctgacataccagtcatcgcattcaacacatcggttaagaatccggaactggttcaatgtaccgttgtttctgataataaggaagccggaaagctgtgtgcccaggctctggcagactctttaggcggaaaaggaaaagtagtagagattacatatagtaccacagaggtttgctatgaccgtcagttaggttttgaagaggaattaaagaagtatcctgacattgagatcatccagaccaaggacgtggagaagccaaagtccgattattcccagccgatcatggtagactttatcaacgcaaacccggtaatcgacggagtatttaccatcaatgatccaacagcccgcggcgccatcgcagccctgaaggaagccggccgcttagatgccaccaaggttgtttccgtagacggttctgacgaaggaaaaggctttatccgcgccgatgaaatggtagcatccgcagcacaggatccggcaggaatcggcacaacctgtatcgaaactgcttaccgccttctttccggacagaccattgaagaaaaggtcgttgtaccaatgtctatcattacaaaggagaacgtagatcagtaatccgcaaagtgctgaccgcagcgaagaatgcagaacaggagtgttaaaaacatgtcaaatgaatatgtttttgaaatgaaagatattaccaaagcgtttggtcgcaacgttgtacttgacggagtcagtatttccataaagcccggagaagtccgggctcttatgggggagaatggtgcgggaaaatccaccctgatgaagatcctgggcggcattttcagcgctgattcgggtaccatctacatggacggaaaggaagcttccataaaaactgtagacgatgcccgcaggtatggtgtcagttttattcatcaggaaatcaccaacattcctgagatgatgattgcagaaaatatttttcttggccgggaaccgaaaaactgtttgaaaatggtggattaccggaaaatgaagcacgaggcgcagaaagctcttgatgcactggggctggatctggatgctggaatgctgatacgggggttatccgtggcacagcagcagatgatagaaattgcacgagcggttaatgagggggcaaaaatcctgattctggacgaacccacagcatctttgtcaaaaagcgagacagacaatctgtttgcacagatcgaccgtttaaaaaaagccggagttgcgatgatctacatctctcatcgtatggaagagacctttaaggtctgcgattcggtaacggtactccgtgacggtaagtttataggaaccagagatacaaaggaaacaacagaaaatgaattgatcagcatgatggtaggccgtgaatttaacaacatgtatggtaacaaacgtgtcatcggcggggacgtcatcatggaagtgaaacatttaacaaccgacaaggtatccgatatcagttttacattgagaaaaggggaaatacttggattctcaggattggtaggggcggggcgtaccgagctggcactggcaatattcggcattgacaccgtccagtcaggagagatctggctggaagggaaaaaacttgccatcagcaggccaaaggatgcaataaacgcaggcatagcactggtgccggaagagcgtaaggaacaggggcttttccttggtcacagcattgcaaccaatctgacattccaggtgctttctgaatttatacatcagttacaagtggacaagaaaaaggaatccaggatcgtggacgagttcaagcagaagctttctattaaaatggcctccattgaacagtcggcaggagagctttccggaggcaatcagcagaagatcgtaatatccaaatggctggcagcaaagccaaaggtacttattttggatgagccgacaagagggatcgatgtaggcgcaaaggcagaaatatataagctgatgcacagccttgccggtgaaggcgtttccataatcatgatttcttcagagcttcctgaaatcatcaacaactccagccggattgccatcatgcgtgaaggacgcctggccggaattctggaccagcaggaaacagaagcttcacaggaaaagatcatgtcatttgcagtgggaggagaacatacaacatgttaagcaagaaaaatcaatcagagacatttaagatacaagcaccaagcctctggaacaccaatccctttatgatctggctgaaacgcaatatggcggccatgatcgcactggtattcctgtgtattgttttatcaattacaaccgatacgtttcttgttaaaaataacctgctcagcgtattgcgccaggtatgcgtaaatggtttcattgcatttggcattacatgcgtattgatctgcggcggcattgatttgtccgtaggctccgttgtagcggctgccggcgtaattgccgtgcgctgcggcaatgcgggactgccggtcaccctttgctttctgatccccctgttatttggtgcggtcattggccttttcaatggatatgttatttcccacacaactctgccgccatttatcgtaaccttatccatgcagatcatcgtccgcggtgtcagctacatattaacaggcggtcagccggcacagtccaataacgaagcatttaacaacatgggtgtaggaagcttcctgggaattcccattccggttgtatttgtaatcgtggcatttgtaatcctttatttcattatgaaccgtacctcctttggacgtcacgtctatgccaccggaggaaacaaggaagcagccaaatacgcaggtgttgataccaaatggatccaggtaagggtattcatcatcagcggtgtaatggcagccttagccggtgtggttctggcagcaagactttattccggtcagccatcggtaggagaaggctttgagcgtgatgcaatcgcagcttccgtacttggcggtacaagctttaacggcggtatcggtacaatgggaggaaccgttatcggtgttctgatcatcggtgttcttaacaacggtatgaacctgcttaagataaacagctattggcagtttgtagtaaagggatgcgtaatccttggggccgtatacgtggattacataaaaaagaggttccctgaaaaagtaatattacataattaagacggaggcataagaacatgatggacattgtggaattaaaaaagaaatgcaatgatatccgcaaggatattattaatatgacagcggatgcagccagcggccatccaggcggttctttatcagcagtagagctgatggcggcgctgttttatacacagatgcgggtggatccaaaggatccggacaacgaggacagggatcgtttcgtactgagcaagggacatgcagctccctgctattatgcggtattaggtgagatgggctttttcgataagggggaattcaaaaacttccgccagctccacagcattcttcaggggcatccggatgcaaagaaggttccgggaatcgatgcttccaccggttctttaggacagggaatctcaattgcagttggcatggcacttggagcaaaggctcagaacaaggatacaaaagtatttacccttcttggtgacggagaactgcaggaaggacaggtttgggaggcgtgcatggcagcggccaactatcacctggacaatctcaccattatcattgacaacaacggcctccagatcgacggagccaatgatcaggttatgtctctcggtgatttatcctccaaattcaaagcatttggattcaatgtactggaactgccggacggcaacaatttagaagaagtgctggcagcttactccatcagcaccatggaaggaaggcccaagtgcatcctggcacacactgttaaaggaaaaggtgtttcctttatggaaaaccaggtaggctggcacggtaaggcaccaagcgaagcagaaagacagcaggcattaaaggaactggaggattgatgacatgagtgaaatgaaagcaattagagtggcatacggtgaggcattggctgaacttggcgaggcaaatgaaaaggttgttgtaatggatgcggatctggcccatgccaccatgactgccacctttgcagaaaagttcccgaaacggttttttaatgcgggcatagcagaagcgaatatggttgatatgagtgcaggcctttctaccatgggatatatccctttttgcagcacctttgccatattcggggcagggcgggcttatgagcaggtaagaaacggcgtagcttatccaaatttcaatgtaaagcttggcatgacccattccggcatcacccttggggaagacgggggaagccatcaggccattgaagatatggctcttatgcgggtaattcccggtatgaccgttgtggttccctgtgatgccagggaaacgcaccgcgccgtaaaggctgttgcagatatgaaaggaccggcttatcttcgtctggcaagacttccaagcccggtatttgaagaggatatgccgtttgtgatcggaaaggcaaacgtattaaaagaaggtacggatgcagtggtatttgcctgcggcatcatggtatctactgtgctggaatgtgcaaaaaagcttgaggcagaaggaaaatctgttacggttgtcaatatgcataccattaagcctattgacagggagtgcattttaaaatatgctgttaagtgcagcaatgtgatcacagtggaggaacacagcattatcggcggtcttggagatgccgttggcgaagttcttctggaaaacaagtgtaacgtaacttttaagaagatcggtgtacaggaccgattcggccagtccggaaagccggaagagcttctggaggaatacggactgagtgagaaacaggtatataatcaaataaaaggagtgttggaagcatgagaatcgcattgattaatgagaacagccaggcggctaagaacggattgatttacaacagcttaaagaaggttgcggatacaaagggctatgaggtggacaactatggcatgtattctgcagaggacagcaattccctgacttatgtacagaacggaatcctggcggctatcctgttaaattccggtgcagcggattatgtggttaccggatgcggaaccggcgaaggcgccatgctggcattaaacagcttccccggcgtgatctgcggccatgtgtgcgatccaagcgacggctacatgtttgcgcagatcaatgacggcaatgctattgcaatgccatttgcaaagggctttggctggggagcagagctgaatctggaatatacatttgaaaagttattctccgaagcaagcggacagggctacccaagggagagggccgttccggagcagagaaataaaaagatcttagatgtggtaagagagaataacttaaaagacatccttacctgcttaaagggacttgaccaggaactggtaaagggcgccgtgggcggcgagaagtttggagagctgttctttgcaaactgcaaggatgaagccattgcagaatacgtaaagggcctgctggcataggaggttccttatgctgaaacataaaccatcgggagttgcccatgtggcaattcccacagatgaaccggaagcaaccgtagctttttatgagagtctgggctttaccagactggtggatggaggaatcaggggaatgctgaagtgtggaacctgtgtcattgaatactaccccagacgccaggacgcaaagcccatcggaaacatcgatcacattgccttaacctgcgaaaatctggatgaagcatatgaggaaatctcagctcagggacataagcttttgtcggacggaatagaatccaaccagatgtttgcacctctcaccaaccgtttctttctttttcagggtcctaatggggaaaagattgaattttgcaaagttggctaattttgaataaataaaattttaaggagaattgccatgagattttttatcgatacagcaaatacggaagaaataaagaaagcaaacgacatgggcatcatctgcggcgttaccaccaatccttccctgatcgcaaaggaaggccgtgactttgcccaggtcatcaaggaaatcacttccatcgtagacggacccatcagcggggaagtaaaggcaaccacagtggatgcggaaggcatgatcgcagaaggccgtgaaatcgcagcgatccatcccaatatggttgtaaagatccccatgaccgtggaaggactgaaagccgttaaggtattgaccggagaaggaatcaagaccaatgtgacgctggtgttttcagctgcccaggcgcttttggccgcccgcgcaggcgcttcctatgtttctccgtttttaggccgtctggatgatatctccatgcccggcattgatctgatttgtgatatcatggatatttttaaagaacatggaattgaaacggaaatcattgctgcaagcgtccgcaacccggtccatgtgatcgactgcgcaaaggcaggggctgatatcgctacagtgccgtacggtgtgctggtgcagatgacaaaacacccgctgaccgaccagggaatcgagaaattcaaggcagattataaagcggtattcggtgagtaatcagttgttttgggcgaagtcttttcagacttcgccctttttgcgattcccatgccccatggtgatccggtatcagagatcgaatgaagtgcttccatttttgaaaaacataaaatctcaatcaaattttaccggaactttgcaacgacccggcagggaagccctgtcatttccgcatagttcaaagggtaggtacaggcgataaaacgggtgttatgctggatcaccttttttaaattgcacaaattctcaatgatgaaaactcccctgtcagcacaatactggtcctttggtgtgtgttcggctcctctgcggatgcctgcaaaatcaattccgattatggagattcccttttctaaaagcctgtcaatcagttcatgggacagctggggatgctgggtaaaatagacctttccgccatatccgtttttttccataaatcctgtgtaaaaggctacgaacatatctgtttccacttcattcatatcaatgtcagaggcttcaatatcgcgtccgcttacgccgctcacatcaaaaacaattcctttccgttctgtataatccaggggaaattctttattcatcacatcaaagtgggttcccaaatgtcctgacaatgattttctttcgtttccctgggcatcagcgatcatgtcaggagtgatttttaaagtaatatcgatcagcataatgattacctcctcattcatatttgtggttatcatatcataccttggggcaggtttctattgtctttggggcgtagtgctgtttttttaccctgcattgatttaaaatgaattgcagctggggatagaatgatagattataaacataatgtataaaaagataaaattcgtaattatcatattttaatacagtggaaaaagtttgcagctcacattcactgtaacaataaatgaattttatataaacaatatttttctgggaaaaacagaaacctaaaaagttagtcgataatttgtgataaaaaacatatactatgacaatacaatgtattgacaatgtattgctattttcatataataatagtgaagggagagtgaaattatggcacagacacttgtgagtatacgcatggatgaagaactcaaaaagagtatggaacagatttgctctgaattgggaataaatatgacgacggctttcactatttttgcaaagaagatgagccgcgaaaaaagaataccttttgatgtatcgatcgacccttttttctctgacagtaacatggcgcatttgcggcggggcgtggaagctttaaacgctggaaaaggcgtggagcatgatataatcgaggcaggggacgaatgagaaaagtggtttgaagaagcgtggaaagattatatctactggcaggcccaggacaaaaagatattaaagcgaattaattccatactgaaggatattgagagaggaggcggctttgagggcattgggaagccagagccccttaaaggtgacttaagcggattctggagccgccgcattgatcatgcaaacaggcttgtttaccggataagcagcgaagtcatagaaatcgtatcctgtatggggcactatgaggattaaaggagaaggcaggaaactgccttttctttttttgtttataaagcatcaataaaaccccaccaatatataaaactgataaggatcatgtttataacttgcataattaaaaaagtagtaataaaatagtttagaggaattcgtaatggtatctggtcatggccattactgtaaatttaaggagaatggtatgattacaattaagaaaatggcagaaatgcttggaaccagcaccactacggtatcaaatgtcattcatggaaagacaggtgaggtttctcctgccatggtggaaaaggtaaagcggctgatagaggaatatgattatgttcccaacatcaatgccaggaatcttgccagaaacaaatcaggaatcatcggacttgccatgaagacaattcgtgagaagtacgataattttatgacggatccctttgctggggaactgaccggtgctgttgaaagctttgtccgggcaaagggatactttaccatgctgtacatctcctccgatattacggagatcataaattccgttgccagctggaatgcagacggccttatattgatgggaatgcagacagaggatgccattcttctgaaacaaaaggtaaaaaacccatggtttttgtggacagctattttggggattcattttttgaatatgtcaatgtagggatcgaagatcagaagggcagctatgaaataacagattatctgattcagaaaggccaccggaaaatcgcctttcttgcagataactgtttaggagtagactaccatcggttcaaagggtatcgggctgcgatggcagaggcagggatcccttatgaggaggaaaattttatcatgctggagccgggcagtccggatatgccttcgcttttatccaatgtgtaccgcagagcaggagattttactgcttttgtatgtgcctctgatttttatgcggccaacatcataaattatttacaggatcatgggataagggtaccggaggatttatctgtggtgggattcgatgacaatatttacagcaatatggtgaggccggcgctgactacggttcaccaggatgtcacacagaaaagcgggattgcggttgaaaagctgtttcatatgatccgtaaggaggattatggagacaagtttgagcagcttactgtttatcttgtggaaagaaactcagtaaaggaaataaaatagcaccataatatgaaaggatgccttgaaacggttgttacagaccggtcaaggcgcctttttttatattgccttaaacgcataagttgtgaagggccgcctgatccacaaatattagcttgtgaaacatgaaaaaactctatatttcatgaaaaaaaataaaaaaacacttgctagagcggctgtaggatgataatataatgtacgaataacttatgcgcataagttacaatgacaagggatagtatttacatattaatagtaaaattaatatatggagggagtattatgaagaagaaactactggctatggcattagcaggagcaatggttttgggaacaatgacgggatgcggaagcagtgccggcaatgcagacagcacagcttccagtgaaggaaagtcagaagctgcaaccggcaagaacggagaggcaattcgtcttgtaaacggaaagatcgaaattgacggtcccttaaaagcctttgcaaaacagtatcaggaaaagaccggacaggaagtggtaatcgaatccctgggcggcggcgtggatattaacggcgctttaaagaattatctggcagcaggaaatatgcctgatattttcgtattcggaggagaaggggattatcagacatggaaggattacatggtggatttaagcggagaagaatgggcttcccagactgatttcggctttaagtcggctgatgataaaaccgttggtttcccatatgcggtggaaggatatggaattacatataacaaggacattctggacgctgccggaattgatcctgcttccctgacaaactatgatgggtttaaaaaggcgtttgagaccattgacggcaagaaggaagagctgggaatcactgcggtttgctctgtagctgcggaatccgggcaaatgtactggtcaacaggaaatcacttgtttggttattacttatccggcggtttaaaaagaggagatgctaaatacattgatatgttaaaagccggcacagtggacaaggaacgtctgggacagtttgcagatttcatgaaactgctttttgattattccgataaaagcactctgatttcaggaacctacgatgaccagctggctttgtgggctcagggaaagactgcattcataactcagggaaactggattgatccctctcttcctgattatcaggtgacgtttggctgcggaatagctcctctggcctttaccaaagaggaaatgaagggcgtgcttgccgattgcccatcctggtggtccgtttacaacaaaggaaataacattgacgcagcaaaagcatttttaaaagagcttgcaacctcagctgacggccagaaaagtcttgtgaccgactgcggaatgatttctccctataccacctgtacggtaagccctgagacacctcttgccaagagcttaaaaacatatgtggatgcaggcaacacttattcctgggaatggacgaagatgccggaaggaatggcaatgaatgccacgggagctgtttttgaattatatgcaaaaggagagatcgacagagatacgtttgttaccatgatggaaaccgcgattgccgattatgtgaaatagtagttagggatgaggcggcttttataagccgccttaactgttaggggctgccgctgcggaagacagaggaagaggtaaggagagtatatatggatggaaatacaaaaaagcttgtattcattttgccggtactgcttggtgtgctgacggtaatttacacactttatttagatttgttccacagggatatggcgatcaggggatttcttctggtccttggacttcttatgatcattgccggattgtactttattccagggaagaggcaccggatgatcgtaaacggattatttttgctgccccttctgggcgcttttggaataacagtcatgattccctttttattcggcatcttttattcctttacaaattggaatgggatcgggtttacaaaggttgtggggctggcaaattacgtggatatgttccggtctcctgactacttatattctcttgcgatcaccttcttatttaccgtgatcaatatgatcttcgtaaatttcacggcgtttgctctggcgcttttgtgtacctcaggggcaagaggaagaaacttttaccgggcgtcatttttccttccaaacctgatcggaggcattgttctgggatatgtatggcagtttatttttaataaagtgttccccgctctttttgaaggtagcctttccatgctgacggatcccaatctggcttttttggccatactgatcgtcagcacctggcagtatgccggttatattatgatgatctatgtgacggggctacaatcagttccaagggatgtgctggaagcctcaggtgttgacggagcaaacgctttaaagaccctgtttcatattaagctgccaatgatagccaatacctttacggtttgcattttcctcactctggttaattcctttaagcagtttgatttaaactttgccattacaaacggagcgcccagcaggatcttgggggcaaaggccattgcctccaccgagtttttggcccttaacatttataatacggccattgcaaagaaccagtatgcccagggacagacaaaagcggttgtgttcttcatcattttggcaatcgtgtctctgacccaggtgaccatcagcaaaaggagggagattgaactgtgagcagaaaattaagaggaaccatcgttgaactgaccgcccttgttttatctcttctggttttatccccctttgtcctggtggtattcaatgcagccaagaaaagcgcggctattgtcataagccccattgcgccgcctgaaaactgggggcagatgtttattaacctgcagaacgtgatccataaccagaatttcagttattggaaatcttttttcagttccttgttcataaccgttgtcagcctggggcttttaaccctcttctccagtatggcagcctgggtattggtccgaaataagacgaagtggtccagtgttattttcatgacatttgttgcggccatggtaattccctttcaggtggtcatgctccctctcttatctacattccgggagctgtctgcctttaccggaatccggcttctcagcagctatacgggaattatcatcgcttacttaggctttggcggttccatgtccgtctttatccttcatggctttataaaaggggttccaagggaactggaagaggctgcatggattgacggctgcagcccggagggaacctttttcagggtcgtattccctcttttaaagccggttcagatgacggttctcatattaaatggaatctggatatggaacgattatcttctgccttcactcatgcttggattaaacggcaggatcaagacgctgccggtggcggtgagcagctttgtaggttcttacgtaaaacagtgggatttaatactggctgccgcctttctggctatgataccggttatcattctcttcctgctggcacagaaacagatcattcagggcatggtagaaggtgcaatcaaataaatcactaagaaaggacagaatagtaaaatggaacgaaaatggtggaaggaagcagtggtgtatcagatttatcccagaagctttatggatagcaacggagatggagtaggagatttaaaggggatcacagagaagctggattacctaaagctgttaggaattgatgtgatatggctttctcccatctaccagtcccccaatgatgacaatggatatgacatcagtgattaccaggagattatggaagagttcggatccatgaaagattttgatgaactgcttcaggaggcccatcaaagaggcataaagctcatcatggatctggtggtaaaccatacgtccgatgagcataagtggttcgtggaaagcagaaccggcaaggataatccttaccgggattattacatatggcgggaagggaaggaagacggaagctgtcctaacaactggggctcctgcttcggcggtcctgcatgggaatatgacagtgagacggagatgtattatcttcacctgttttccaggaagcagccggatttaaactgggataatcccaaggtgagagacgaaatatatgaaatgatggactggtggtgtcagaaaggcattgacggcttccgaatggatgtgatcaatttaatatcaaaagatccccggcttcccgacggcgagttaacggatgggctgtacggtgatttttctccatatgcatccagcggtcccaatgttcatacttatttaaaggaaatgaaccgcagggtattgtcaaagtatgacttaatgaccgttggggaggcctttggcgttacccttgaggaagcaaaaagatactccggcgaaaaggaacaggagcttaatatggtattccattttgagcatgtgtcaataaacggtgaaatcgggaagtggacggataaaaggcctgatctgctggaattaaaacggattttttccaaatggcagacagggcttgaggagggtgcctggaacagcctgtattgggataatcacgatcagcccagagccgtttcacagtttggagatgacagtgaaaaatacagggaactttcggccaagatgcttgccacgtgcctccacctgctgaagggactccctacatttatcagggagaggagctggggatgacgaattttcctttccaggatatatctcagtttaaggatatagaaagcttaaatatctatgagcagctggtgggcgcagggctggtgagccatgagaaaatgatgagctgcttaagatttaaaagcagggacaatgcaaggactcccatgcagtggaatgatgaactccatgcagggttcacatcaggcctcccctggatccaggtaaatccaaactataaggaaatcaatgctgaaaaggaattggcggacgaaaattctgtattccattattataagaagctgatccaactgaggaaacaccatgacatcatcgtgtatggcgaatacgagcctttgatggaggaggattccagggtatttgcctttatcaggaagctgggagaggaaaaactgcttgtattatgtaactttacggatgaggaattacaggtttctatacctgaggaattttatgggaggatgtggaacgcctgatcagcaattatgagcagccggccagggagaacaaaaacaggcttcttccttatgaagcggttgtatatatcatgtatgaaggcagaaagatgcttatataacctgagacaatatttaaagaaaaaattgacagatgactggatggagaatgcggatatgaagaaacaatggtggcatgacaagatagcgtatcagatttatcctaagagctttaaggataccaatgaggatggaatcgggatataaagggtgtgacagagaaactggattatttaaaggagctgggcattgacatcatatggctttcacccatctatgcttctccccttgcagaccaggggtatgatatttcagattattataacattgatccaaggttcggaaccatggaagagcttgaagagctgataaaggaagccaaaaagagagagatgtatattctcatggatctggtggtcaaccactgctccgatgaacatgaatggtttaagaaagcaatggaagaccctgacggagagtatggaaagtatttttatattatggaaggaaaggatggaaaagagcccagcaacatccggtcctactttggcggaagcgcctgggagcgaataggggatatggaccggtattatcttcacctcttccataagaagcagccggaccttaactgggaaaatcctgtggtgagaaaggaaatctatgccatgatcaactggtggctggaaaaggggattgcaggcttccgcatcgacgccatcataaacattaaaaaggcccttccattccacgactatgaacctgaccgggaagatgggctggcaacctgtaaaaagatgctggaagaggctgcaggagtgatggacttcttaaaggagatgaatgattccacctttaagaaataccatgcagttactgttggtgaagtttttaacgaaaaaaaggaagaccttccggatttcatcggagaggaaggctgcttttcctccatgttcgattttaatgaaactatattcggagccagtgaaaaaggctggtttgataaccagaccattacccctgatgattaccgggactgctgtttcggcagccagctcagggcggaaggaatcggatttttatccaatatcattgaaaaccacgatgaacccaggggagtcagccggtacataccggaaggggaatgcagcgatacctccaagaagcttctggcaaccgtctattttctcttaaagggtctgccctttatttaccagggacaggaaatcggaatggagaatgtgcccttccggtccattgacgatgtggatgacatttccaccctggacgaatacaaggtggccctgaaacatggaatcccggaagatgaggcatttaagaccgtgtgccgttacagcagggataatgccagagtgcctttccagtgggatgacagccaaaacgcgggatttacggaaggaactccctggatcatggtcaatccggaatatgagaagatcaacttaaagcttcaaaaagacgatcctgattccgtattcagttattacaaaaagctcattgcccttagaaaacaggaagaatataaggatacctttgtttatgggacaatggtacctgtttatcaggacagaaccaggatcatggcctacttccgtaaaggggagaaccaggatatcctggtgatcggcaactttcagacagaacctcagacggttgagctgcccggggaatacagccgggtgttattaaataaccatgatgagatttcctgtgaggggaaaaaacttgatttaaaaggttatcaggtactggtattggaactgggctgaccggagaaaaaaccaggactcctttcaggccggagcagcaagcttttataagcagctgtcccggccttttttcttcaaatccatattaaagaaaaggattccctaaaaaacagcttgaaataaccggttcaaaaaaatataataataggatcaacggaatagccggaaacacggctcttgatttcatgaagataaagtcagagcatacatatggaggaaccggaatgaagaaagagatacttgcaggagaacactgtccatactgcaaaaggcattgttctttaaaatcccctcattgcggaaaggggaaagcattggcagagaaaaagttaaaggaagagaagaagttaaaggaagagaaggagcttaaggcagaaagaaagttaaaggaaaagctgccgtttaaggagaccgatggggcaaagaccggaactggggagggaccggtcataaattcagaaacagaggaatggaagaatatccagtctgaaatcaggctggtgtgcctttatcaaaggagctgcaagctgttgtctgataagaaggcaggaaaacagggaggtaaggcagtgcggctttccatattggcggcactggcggaaaaggatggcctgacacaaaaggagcttaaggaaaattccgggctggattccggggaactggaagaggctttgcaaaagctggagaaaaaggggtatgtcggcaggaagccggctgaaggaagcgatgtgagggtctctcttaccggtaaagggcttgagtcagccaaagaatatataagggactggaagaaggaaaatgactgtattttttcccggcttacggaagaagaaaaaggctttttggaacatatcctgaaaaaaatcatgaagtgaaccagcttcgacatgaatctgttattttccagaagaccagggttgtgtttcgtataaatttgtagtacaatgcaacaggatatcatccgattattatgcttttttatcatgcggctgccgcaggagggtaccattgagatattatgtaaagaaaaccagggctgtcagccggacgctggcattcttattttgcattgtcttatttttaggagaactgaatgtgctgggcatggactggaatccgggacaggcccgtttggttttaacgcaagcccaaccaaagggatatgcccatccgaaaagaaatgatgcggtcgctgaaattccgggagttgtggaggaagaggctgccggtgaaaatttggtcgacgcctggggcaggtccttatatggcatcttaccgttaaagtatatagcggccagggaattcttcctgtttgtcccgcttattttatggtcagaacgaaccgtgctgatgaaggaagggtataccggcagagaatatctgatcaggtacattcatgattcagacggtgaaaaaggtgtaagggcaggagttttaaaggtaagttaataaattaacaagaaaagaggataacctatgaagccaggaaagaaaatacttgccgcgatttttgtggtaattgcggctctcatttatgttgcggtattcggagccggagaaagtgttaagggcgtatttgatatgcgtttcggcatcgacatccgcggaggagtggaggcgatctttgaaccccaggggcttgaccgcaatccaacggaaaaggagcttgaaacagcgagggaagttattgaaacccgaatggataaccagaacatcgtggaccgtgaagtgaccgtggataccaacggaggatatatcatcgttcagttcccatggaaatccggtgaaaccaactttaatccggaggatgccattgcagaattgggagagatggctgagcttacattccaggatcctgatggaaatgtgctgattcagggtaaggatgtgcagaatgcagcgccggagacagccaataccaacgggatcaagacctatcaggtggctctcagctttaatgccaatggcgcaaagctgtttgaggaggcaacaggaaatctcatcggaaagcggatgagcatatacatggataaggatctcatctccagccccactgttcagaccaagatatcaggcggacaggcagtgattacagggatgaaggattatgacgaggcaaagaatctggcagaaaagatcaatgcaggttctcttccgttttctcttaaaaccaccaatttctctaccataagcccgtccttgggaaataatgctttaacaattatggtgtatgcaggaattgctgcatttgtcgtgatctgtctgttcatgatcgcattttataagctgccgggcgtcattgcctgcatcactctggttttgcagatggttctgcagctgcttgccatctccgttccccagtataccctgacccttccgggtattgcaggtattatactgaccctgggtatggcagttgatacgaatattattatttcagagcgtatatccgatgagctgaaaaagggcatttccgtaaaaggtgcggtattgaccggatataaaaatgccttttcatctgttttagacggaaatgtaaccactgccattgttgccataatcctgatgtttttaggatcaggcaccatgctgagctttggttataccttattgatcggtatgatcgtaaaccttttggtgggtgtttccgtttccaagcagcttttattatcctttgttcagtatgatccgtggcgcgatgaaaaatggttccggatcagaaaagataaaaagaccataccattttatcagaaaaagtttatttttgggattatctccggagcggttattctttccggaatcatcggctgttttgtttttggcgtaaagctggatacccagtttacgggaggtgcggtattaagctattccgtaacagaggatgcggatacaggtaagatccaggcggcaattgaaaagcagacaagccggccggttacggttcagatcaaagaagataacatgacagggcttaagaggctttccatcacacttgcaggaaattccggaatgtctccggaagaccagaagcaggtgaccgatgccatcaacaccaccctggatgcggcagatgcaaagctgtcggagacttttgtggttgagccttatatcggggcaaaggcaatgaagaacgcaggccttgccattctattatccctggtgtttattgttgtatatgtatggatccggttttcaaccatttccggccttccggcaggagttactgccatgattgccctgctccatgatgtgattgtggtgttctttgtattcgtgctgttccggatcccgttaaacgatgcctttgtggcggtagtcctcacgattatcggttattccatcaacgataccatcgttatttatgaccgaatccgtgagaacagaaagaaggattctaaaatgccggttgatgaactggtaaatctcagcactacccagacccttggaagatccatcaatacgtcctgtaccacagggatctgtgtgctcatcattttggctgcttcggtctatttccagatcgggtccattttagagttttctcttcccatgttctttggtatcctgaccggatgctattcctccatttgcgtggcaggtacgctttgggccatgtgggaaaagaagaaagaaaaaaagtaaaagcttactggtaagcccgtagaggccgcagcttcatccctgaatgttcagagacggagcagcggcctttttgtgcgaaaaggagcgcatgaaataaggtttttttcaggtgtaaagcaggggaattataatcctgcaggatctatcctaaaatgtaaaattgatagcaataagtctttgaatatgcgtatgcaaacagatttgactgggttattatcagacgttatatgaaataaaatatttttattacaccattgaataatttaccaaaagatgttagaatatgatatatcatttttacggaggtgttatatgcagaaatatgagtgtccatgtggttatatttatgatccggaattaggtgatccggacaatggagttgaaccaggcactgcctgggaggatgtccctgatgattggacatgccctgtctgtggtttagaaaaggatgcatttaatgcaatctgataggtaaggagtaaatagaaaaaaggttaaaggagggtgaagattttgttaaataaagatattgttgcgaagataaacaaacagatcaattttgagctgtattcggcttacatttatctggatatatccaactattatgcggacagtaatttaaacggctttgcaaactggtttaagatccagactcaggaagagcgggatcatgccatgctctttatggattatttgcttaacaatggtgaaaaggttgtattggaagatattaaggctcccgattttgtttacacggatttccgccagccggctacgactgcctatgaccatgaggtaaaggtaacagcctccattcatgatatttatggagccgcttacgaattaaaagatttccgtaccatgcagttccttgactggttcgtaaaagaacagaatgaagaggagaaaaatacggatgatatcataaaaagatatgatttattcggaaatgatgcaaagggattgtatttgctggatacagagctgggggcaagagtttatgcgccgccttcacttgtgctttaatctccacagtgtcataaccataattctaaagaagagcattctctgccatgatgggaacgattgttttccggcagggaatgttctttcgttattattgtccatgttttttggacagaaaccacccgcttcagagcctgccccttgatcgggcaccgagtgtaacggtataaccgcagggggctttcattttacggcacaggcttaggctttcataaaagttacctggacaaaggaggaaagacgttagtggcaaaacaaagggagagggtggaattccgctactatgggattccggagacagaatcggtcctggctcttttaggtgaggactggatcagggagtatggaaaggagatcaagtaccttcattttcatgatctcatggaaatcggatactgtcactggggagacggggaagtgatgctgggacaggagcaggttcctttttccggccattccataatgattgtacccccaaggcttccccatactaccaacagtgtggaagggacaaaaggatattgggagtggatatacattgatatggaaaaaaccgtatgtgaagtatatggatatgatccgatgcttcaaagaaccatattaaagaggcttcaccggacaggctatcttttgccgggagatgaaaatcctgctctttccatactggtcctggggatcatggaggaagtccgacataaaaagccttattacaaggaaagcatacggggatatctctatgcctttatggcagagcttttgcgtctttccgatgatgaggaacggatcaggaaggggaggagccgtgacgccgtccttacaggggccctggattatgttgcagcccattatgctaaggaaataaaaataaacgatttagcagaggcctgcagcatgagcgaaagtcatttccgtcgtgtttttgaggaggggatgaacatgaaacctttggattatgtcaatcttgtccgggtacaaaatgcctgcgaactgctgaagaaaacagataaatccatggaggaagttggtgcggaatctggatttgcctctatttccgcgtttaatcggaatttcaggaaattactggatatttctccctaccaatggaaaaagtcggaagagaattatgaaggaaagctgctgaattataaaatcagcgcacaaagaggctgggactaaggaagaaatgattgaatatgcgcatttttcaattgaatataaaaactttaaatcaaaaaagttggtataatgtgattatcagaaatctttcgaaagaaaaagagaatcaaatgagtcaattttttatgaaagaggaggagttttgaaatgaagaagagaattgcatccatattactggccggagccatggcggcttccttaacagcctgcgggacttccggcggcacaggacagaaggcaggagatgaggccaaggccgcaaacgagctgactgtctggtgctgggatccggcgtttaatatttacgccatggaggaagctgcaaaggtataccagaaagaccatccggattttaagctgaacgtggtggaaaccccttgggctgacgttcagaccaagctgacaacagcggctacttccaaaaacctggatacacttccggatattctgctgatgcaggacaatgcattccagaagaatgtaatcagctatcccgatgcatttaaggatttaaccggaagcggaattgatttttcccagtttccaaaggccaagacagcttactctgttgttggagaaaaaaattacggtgttccctttgacaacggagcagccattgctgcttaccgtaccgatgtgttaaaggaggccggattcacggaggaggattttacggacattacctggagcaagtatcagtccatgggcgaggagattttagctaagacaggaaagcctctgttatcctgtacggcaggagagtctgacttaatcatgatcatgcttcagtcagcaggcggcagcctttttgatgaggctggaaatccaagcatggttggaaatgataagctgaaaaaggttatggaaacctatgtttcccttgttaagagcggtgttcttgtagaagtcaatgactgggatcagtatgtgggaactatgacaaacagcactgtggcaggaaccataaacggctgctggatcatggcaagcattcagaccgcagaggaccagtccggcaaatgggcgattaccaatatccctatgcttgagggagtagacggtgcatccaattattccaacaacggcggttccagctgggccgtgactgcgggaagcaagaatccggagctggcggcggatttcctgtcaaagacctttgcaggaagcgttccattctatgagaccatccttccaaaatcaggagcactggcaacctatcttccggcagcggacagcaaggtttatggagagcctcaggaattcttcggcggaaagccggtttatgcccagatcacggagtttgcgtcaaaggttccttctaataatacaggtgtttattattatgaggcccgtgatgcggtagcaactgcaattaccaatgtggtttcaggagcagacattgaagcggaaatcaagaccgcagaagacacggtcaagtttgctatgggtaaataaaaataagagggaggaggcattttagtgggaaattcaaagaaaaagctgtcattaggccggaagcagagcctggcaggctgggtatttttaacgcctgcggtcattctgattgcagttatgagctttctgcccatgattcaggcgctgttcttatcctttcagacggggatcggtgcggcaatgaagtggacgggcgggaccaattatgtaagaatgttcaaagatcctgtttttatgcaggccctgaaaaacaattttatttacctgatcatacaggttcccatcatgctgatatcagcgctgatcctggcttccctgctgaacaataaggatcttcggttcaagggtcttttccgaacagcgatttttctgccctgtgccacctccctggtatcctatgcggtcattttccgttccctgtttgcagtggacgggctggtcaacatcatcctcataaagcttgggctgctgtccacaggatacaatttcctgggtcatcctaactctgccaggatcgtgatcatcctggccctgatctggagatggaccggctataacatggtgttttatctttccggtttgcagaacattgagtattccgtgtacgaggcggctaaaattgacggagcctccccgctccagtctttcttccggatcaccattccgcttttaagaccaaccatcctgctgacagctattatgtcaaccaacggtaccctgcagctgtttgatgagtccgtgaacttaaccaacggcggaccggccaattccaccatcaccatgtcccactatatttataatgtatcgtttaagtacgtgccaaacttcgggtatgcggcttccatgtcctacttaatcctgatcctggtggcagttcttgcatatatacagatgaaggtaggtgataagcgtgactaaagggaaaaagtttcttgcatatgcatttttgaccattgtctctctcatctcggtatttcctttgtattggatgatggttgcggccaccaataaaagcgtggatgtgtccagagggaccctggtgttcggcacagcgctttttgacaacataaaaaagctgtttgattcccagaatgttgtcactgcccttgggaattcctttaagtattccatcatcatgaccctgatctccctcctggtatgttccattgcagggtatgggtttgaggtatttcatgacaaggcaaaggaccgtgtcatgagcgtgatcctgctggccatgatggttccctttgcggcaaccatgatccccttataccggatgttttcaagtgcaaggctgttaaacagcaccctgggatttatcctgcctaccatatccaccccgtttctgatcatgatgttccgccagagcgccaggtcctttccgtcggatattatggaagcggcaaggcttgacgggttaacggaattccagattttttaccggatgtttcttccgaccatgcgctctacctatgcagcggccatgaccattacctttatgagtgcctggaacagttatctttggcccaaggtgatcatgtccgatgccagcagcattaccatgcccatgctggtggccaacttaacggaaggatacgtgaccgattatggaatccttatgctggccgtactggtctgcaccattcctactgtaatcgttttcttccttctgcagagaagctttgcagaaggcatcacaggagcagtcaaataaaaacgcgatcatagcagatgctgtggccgatttccatatccggaagccggccgcggcatttttatgaaaacaccgtctctatgtccaaaaggcatggacagtaataaggaaacaccctgcgggtatacctgtatgtccaaaaggcatggacggtaataaggaaacagtgataacgaaaggaatagaaaagtatgaaaaaccttggcatttggcacggcggggattacagccctgagcagtggcttgatgagcctgagatcttaaaaaaggatctggaatatatgaaaaaggccggaatcaatacggtaaccatgggaatgttcgcctggtccttcctggagccggaggagggagtatttgacctttcctggctaaaggaacgggtagatattctctataaaaacgggatatccaccatcatgggaactccatccggcgcccgtcccaaatggatggctgaccggtaccaggaggtgctgcgggtggatgacacaggaagacgccagcgctttgggggacggcacaaccattgctgcacctctcctgtgtacagggagaaaataaagacggtcaatgaaaagctggcggagcagttcgcctctcatcccggagtacgtatgtggcatatctccaatgaatacggcggggaatgccactgtcccttgtgtcaggacgccttccggaaatggctggaaaaaaggtacggaaccattgaacgcttaaaccgaagctggtgcacagccttctggagccacggctatcagtcctttgatcaggtggagagcccctcttccataggagagaccatggtccatggcttaaatctggactggaagcggtttgtgacggatcagaccatggattttgcccggtgggaggccgcctctttgcgggaagccggtgcaaaacagcctgtcaccaccaatttcatgtatgactatcagggacttaattaccggaagctttctcaggcagtggacgtaatttcctgggacacctatcctttatggcataaggaaaaggaaatccttacggccagggacaacggaatgcagcatgattttatgagaagcttaaagaagaagccttttctcctcatggaatcctgcccaagcagcacaaactggcagggagtcagtaagctgaaaaaaccaggacttttaagactggcctcctggcaggccgttgcccatgggtcggacagcgtcttgtattttcagatacgccaaagtccgggaagctgggaaaaatttcacggggctgtcatcgaccattacggaaaaacagacaccagggtgtttgaagaggtcagcctcataggaaaagagcttgcatttctgggagaattggccggaaccggagtacggccccaggcggccctgatctatgacgtggaaaaccggtgggcaatggaggacgcacaaggtcccagaaataaagggctatattatcatgagacctgtgtaaagatttacagcgccattaaaaagatgggatttaacgtggatgtaattactatggaggacagtctggaggattaccggcttgtggcggctcccatgctttacctataccgcagcaaaattgaggagaaaatggaacggtttgtccgaagcggcggacaactggtcactacctattggtccggaattgtggatgaatcagacagatgcttttccggtggggttccccatgggctgagagaggtggtggggcttcgcagcacggaaatcgatggtctttatgactgggagcgcaattatatggttcctgcatccggggaaaaaggggaacggtatgagtgccgcaatctctgtgatctggtgaggcttgacggagcagaggctcttatggtatatgaaaatgatttttataagggatatccggcccttacaagaaatcactatggaaagggaatggcctattatgtatgcgccgatggagaacaggatttttatgatgatttattctggaaggtggcctgtgaagccggaatcaaacctcttgtggaagggctgatcccggaagaggttgaagtgacttccagggaatcggatcagtatgagtatctgtttttgcagaatttcagccggcaacctgctgtgctggaacagaagcttttagacagcctgtcagatggaagggggctgcttggggagatttcgggaaaaggcgaaatagaaccatatggaacggtgatcataagaagagatctgcaccggagctgaggcagctttttgactcttttggtttatttcttaattgccaggcatgttagtttatgctaaacttttcttagaaaacaccctgcgggtatccctttacacccgatgcccgataaagcggggaaggcactaaagcggggtaggctctgtccaaaaagcgtggacagtaataaggaaacaattatgtttaaagggcgcggcgttcgcttaagaggaattcacatgggaaaaattgcattgcttgtatccagggaagaaatgctgcatcagacgcacaatattctccaggaaaaaaaatacgagatcagtgatatgcgggtaattaaaacggaagatgctgtttccgaggcaaggcattccatcggggccggggcttccattatcattgccagagggcttcaggcctccttaatcaagcagtatacggatattccggtggtggaaatcgttatcactgcccaggaaatggcccttctggtcaataaggcaaaacagattttaaagaaagaaaatcctgtcatcggcgttgtggggttccggaatatgttctgcgatatgtcctattttgatatcatttatggaattgaaatgaggacctattttgcagataaaagtcatttgcttgaggatatgacaaaacaggctataggggatggggtggacttgatcattggaggagatacggcagtgggaatagccggagaggccgggatcccgtccctgtttttatccaataccgaggattccttaagaaatgccttgtcaatggccgaaagcatggattatgccatgggagtggagaagcgcagtgcagcgcagatggaaacgcttttggaccattccttcagcggcgttgtaaggcttgacgcttccgggttcattctggatttaaatccaattatggaaaatattctggggctgaaaaaagatgaggtattaggaaaggctgcctgtgaggtatttccggagcttggaaaagactatgggaaggaatcctattccctgtttatggagatcaaccgcacctctgtttttgccgttgtggccccggtggtcattgaccaaagggcagagggagccattctcacctgccaccgcatgaaaaaacgccggctggcggaatcggattccagggaaaagggccatttaagaggcttcattgccctgggggaatttgaggatattcttcaggaatcccaggcaatggaggaatgcatacgcctggcgaagctgtatgcactttcggaaaaagcggtcttgattgaaggggaggctggaacagaaaagcgcctactggcccaaagcatccacaacgcaagcctgcaaaagggaggcccgtttgtggcattgtcctgtgatgggctgggggatgaagggcagcttgacatgatctttggagataagggagcggtcgcccaggcaaagggaggcactcttttgctggaagaggtgcagtgtctaacaagagccaatcaataccgtctatgccagctgatccggtataaaagccgtcttggtaaagacggggctaggtatcctggggctgatgtaagggttatggtcaccactgatgtgcctttgtcagacttagccggagatggggcaatacgggaagatctctattatcttctgagtggtttgacggtgcgtatccctcctttaagggaacggaaagaggatttggagcggaagctgacggaaagcatcagagactgctgcgaacattattccagatttcatgtactgactcatggcgccaggaagctgctgcttgattacccctgggagggaaatttatttcaggtggagagcttttgcgaacgcctgatccttacggccaaaaagcgaagtcttgatgaaggctttgcagaacaggttttaggggaactgtatccccggcccttaaaggcgggctgggaagaagagggagaggaaaatgaccggatcatgcctgttccggaagaagcagaaaggattgcagaggctcttttaaggtttggaggtaacagggaggagacggcaaaagccctgggtatcagcaaggcgaccctgtggagaaaaagaaagaagtatcatctggaatagtagattgaaataataatgaaacgaatttgagataaaattgaaataatatgaggtttgtacaggaaacagctttacattaggttaatccgcccatagtaatatccttccattttttctataatcaagacagtgatgggaaagtccatcggttgctgaaagacagtataggaaagaaaggaagaatcatatgaaaatcggatttattggattgggaatcatgggaaggcctatggcaaagaacctggtaaaggcaggacatgagctggttgtttttgattataacaaggaggctgtggcagatttaatttcctgcggtgcaacggaagcggcaaatggtaaggaagcggcttctcaaagtgaggtggtcatcaccatggtgcccaactctccccatgtaagagcagcagttttaggagagaacggagttgcagaaggagcaaagccaggcaccgttgtcattgacatgagttccattgaccctacggaaagcagggccatcggtgctgagctggaaaagcagggaattgagatgcttgatgcgcccgtatccggcggagagccaaaggccattgacggaaccttatccgtgatggtgggcggcaaaaaagaattatttgataaatattatgatatgctcatggtaatggccggctccgtggtatatgtaggcggacttggctccggaaatgtggccaagctggcaaaccagatggtggttgccgtgaatattgcggcagtatccgaggctcttacctttgcaaaaaaagccggaactgatccggaactggtatatcaggctatccgcggcggcctggcaggctccacggttatggatgcaaaagcgcccatgatccttaacagaaactttaatccgggctttcgcattgagctgcatattaaggacttgaacaatgcgttaaatgctgcccatgccgtcagttcaccggctccattgaccgggcagttaatggaaatcatgcaggggcttaaagcggatggctttgaaaaggaggatcactccagcatcgtcaaatattatgagaagattgccaatacaactgtaaaacctgggaaataaaacctgggagtataaatgagcaaaaaatgtgaagctggaggaaccatgaatacagattttataaaaggagttattgtcccaattctcactcccattgatgagaatgagaggatcgatgaagcaaaattaagggatcaggtggattacgttattaacggaggcgttctgggaatcctggcctttggaagcaacggagaattttatgtggtggaagaagacgagatggagcggggcttaaccatcatgatccatcagtccgccggcagagttcccgtatactttggcattggcgccatcagtacgaaaaagtgctgccgcctggcaaagatggcggtggaaaacggagcagctggaatttctgttttgcagccaatgtttttaaaaccaacggaggaagagctgtatctgcattttaaaaccattgcagaagctgttccccaaatacctgtccttctttataacaaccctgcccgggtgggatacactctgtccggaaatctggtggagcgtctggctcaagaggtccccaatattgtgggtatgaaggacaccagcggggacattacccagacagcggaattcatccgaaggacccgccataagggctttaaggtttttggaggaaaggatacccttctgtatgcttccatgtgtcacggtgcagtaggaggcgtgtgtactgcggctaattttatgccggagctgattacggatgtttacaataaatacgctgcaggcgatttaagcggttccctggaagcccagtttaagctgaatccggtccgtttgtccatggaccctgcaagctttcccgtagctgcaaaggatatggcaaatctaaggggcagaaatgtagggcttccctataagcccaatcttgcgaccccggaaggccctgtattagcccgtattaaaaaggaaatggagacagcagggcttctctaattcataggatcagtagacaggcgggcggctgtgaaaggacgccggcctgttttgcacatacataacagaaaggggtatcatattatgaaatttttatttgcatctgattcctttaaaggctccttatcatctgaaaaaatcgtggaaatcctgacggaatccgcgaaatgcatatttcctgactgccagtgccggggcgtatccgttgccgacggaggcgaggggaccgtggaagcggtggttcatgccatgggaggaagcctccgttgtgtttctgttcacgggccattgatggaagagacaaccgcaacctatggggtattccagaacagccatgcagtcattgagatggctgcagcctccggccttcccatggttccggctgaaaagagaaatcctcttcataccactacctatggaacaggagaactgataaaggatgccctggaccagggataccgcaatatttccattgccattggaggaagcgccacaaatgacggaggaatgggagccatgtcagcccttggggtgcgattccttgataaggaaggaaatgttctgaccggattcggtgaggatcttggaaaggttcacagcattgatggaaagggacttcatccggctgcagcagaaacagagtttacggtgatgtgcgatgtgaccaatcctcttacaggactgaacggagccacctatacctttggtaagcaaaaagggggcaccccggaaatccttgaaagactggaaaaggatatggaggcatacgcaggaaaactgctggatcttacgggcattgatgtcaatcagattcccggctcaggagcagcaggcggtcttggggctgccttaaaggtctttcttcatgcaaatatgaagtcaggaattgaaacagtcctggatctcattgaatttgattcgctgctggagggagtggacttagtcatcacaggggaaggccgtatggactggcagtctgcctttggaaaggtgcccagcggaatcggaatgcgctgcaaggcaaaggggattccggctcttgcaattgtaggcgggctgggagaaggcgcagagaagatctatgagtttggcattgaaagcatcatgacaaccatacagggagccatgtctgtggaggaagccatagaacgggccgaagaattataccggagcgcggccgaccggaccttccacatgctgcgcacaggaaggaagctgaatccgtaaaaggctgcaggcaggaagcattgataaagaaggattggaggagtggcagatggagaaaatggtagcattacccgatggaaccctggtgccggcaatcggacagggcacctggctccttggggagcagaggggaaaacacgagaaagaggcagaggctcttaaggcgggaattgatgcagggatgacattgatcgatacggctgaaatgtatggaaacggaaaatctgaagaactgatcggagaagccatatccggctatgacaggagcggtctgtttctggtatccaaggtctatcctcacaatgcaggaagaaagcatatatttaagagctgtattgagactatgaaacgcctgaatacggattatctggacttgtatctgcttcactggcggggaagcatccctctggaagagacggtggagtgcatggagcagttgaaaaaggagggaaagatcctgggctggggcgtatccaactttgatacccatgacatggaagagctgtggagggttccgggggaaaacaatgtgcggtcaaccaggtgctttaccaccttgcgtccagaggcattgaatatgatcttcttccctggatgaggcagcataaggttcctgttatggcttactgcccctggcccaggcaggagatttaaaacaagggctttatgagaaccaggttttatctgcgatcggggctgcccatgggtgcagcatttcccaggtgctgctggcctttgccatccgaaacggtgatatcattgccatacccagaaccggaaaaaaggaacatgccatggacaatgcaaaagcaggggaactggaactgaccgaaaaagaattttcggagcttgaccgggcctttcctgcgccaggtaaaaaggtgtacttagacattgtgtgaaaagcctgtcaaagggcttattggggataggaagtggggacagctatggaacagatcgggatccttctgcccaggcagaccattctggagtttgcggaaaatgtgctgaaaagagagggaattgaagtacaggtcttaaaggtagtggaaaatgcaaatgctgtggtggaggcacaggaagccctggcagcaggagtgcgcattattattgccaggggccttcaggccaccctcattaaagagaataccaacatccctgtagtggaaatgcctgtcaccatcagggaaatcggtatgatgatacggaaggcaaaggggatgctgaaaaaagagcatcccttaatcggtattgttgcatttaaaaatatgtttgacagcctggaccacttagacgaattatttgactgcactctccgtttttatgagctgaaggctctggaggagacacgcatgaaagtgagccaggcgattgcagacggggtggatttaatcatcgggggagtgaaagccaatcagacggcttttgagatcggttttccaagcctgtttgtggaaacaggagaggaatccatccgcagtgctcttggtttggccatccacatgatagacttagcaaagatggaaaaacaaaatgaggcccagatcgagaccttactggatacttccttcagcggaatcattaaaatcaacgcttacaaagaaattgtgaccgtgaaccgggtgatcgagcagataatgggaaaacctgcttcagaagtggtgggatttcccattgataaggtgatcagggggatagatacggaaggcatcgaaggaattttaaggggaagtgaggagctttattccacctcattttccattggagaccagcccctgatggtggtgggagcgccgattcagtatgacggacatttcagcggggccattctgacctgccataagatgaagggaatagaaagaagggatcctgaggcggcaggggccaagctggctaacggatacattgccagccgcaatttcggccatatcctgcgggaatctccggaaatgaagcggtgcatcaagctggccagatcctatgccgtatccaaaagccctgtggtgattttcggcgagacaggaacggaaaaagagatactggcagaagctctccacaacaacagcccccaaaagggaggcccttttttaaatattaactgcggctccttatcccctcaggagcagagagaagtcatcttcggcttttcagaggaaagcaggaaaggggcctgggagaaggctgcttatggaacggtcctgcttcaggaagtggataggctgtccttagagacccaatatctcctttataaggctgtccatgataagctgttctggtgcaacaattccatggtaaaacgggcccttccggtgcggcttatggtcaccacctcaaaggagctgaccctgctggtgaagaacggcctgttccgggaagatttatatttccttctttcttcccttaagatcgagctgcctccccttcgcaagaccagggaagacatttccagactggtccgcctgtatctggatcggttcaatgctgcctattctaaatatgtggaaatcagtgcggccgctttaaaggccatggaggagtattgttgggaaggtaatttacttcagctggaggttttttgcgaacgcctgattctctcggctcaccgcagacgggtggaggaagggatggtgaaagatcttttacaggagctttatcccctggtaagagagcaaaacggaagaattcagaccatagtgctaaagaatcctgatgcagtccgcattgcggcgctgctggataagcatcagggcaaccgggccatggcggcggaggaacttcagatcagcaccaccaccttgtggaggaagatgaaacggtatgggatcggaagtaaatatgagctgtaacaggagggaacttctgtttattgaaagagattgcaatttttttgcaatctttttttcattattggaaggaaaaataaaggctacaagagaaggggaataaggttggtatttctgtcaatagatggagtcctgaaataaggttataattcaccataaggttaaaaagggatgaagaaaaggagatatcacaatgacaccaatcatcacaaaaatggaagtttatcctgtagccggaaaagactgcatggaactgaatttaagcggagcccatgcgccgttttttaccagaaatatcgtagttcttcatggggacaacggcgagacaggcgtgggggaagtgccgggaggggagaaaatcacccgtgctttatcagagtgcgtttctcttgtagagggcacgaaaataggggaatataaaagcacattgttaagggtaaaggcttaccttgaaacaaggggagaagaggatgtaaggggaaatcagacctttgatctgcgcacaggagtccatgtgctgacggccattgaagcgccctgcctggatcttcttggaaaatatctgggcgtgccggcgtgtgagcttttaggggacgggaaacagagggaccgggtagagatgctggggtatttgttctttaccggagaccggaataaaacagacctgccttatgattcggagcctgatgcagaatgggaatggtaccgtctccgccatgaagaagccctgacaggggaaaagatcgttgcagctgcaagggctgccaaggaaaaatacgggtttaaggattttaaattaaagggggcgttttatccggaagggaagagatggaagtgatccgggagctgaaaaaggcatttccagaagcacgcattgacttagaccctaacggcgcctggctccttacggatgcggttgagtatgtgaagggaatggaggggatcctgacctactgtgaggatccctgcggggcagaaggtggatattcaggaagagaaattgtcagcgaattccgccgcaggacagggtttcctactgcaaccaacatgattgcgacggactggcgggaggtgggacacgccctggagtgccaggctgttgatatcatcctcgctgaccctcatttctggaccatgagcggttctgtgcgggtggcccagatgtgccatgagtttggctatacctggggctctcattccaacaatcatttcgatatttcactggcaatgttcacccaggtgggggcggcggttccggggagatacaacgccttagatacccactggatctggcaggagggcttggagaggctgacaaaggagcctcttttaatcatagacggctgcgtggaggttcctaagaagcctggccttggcattgaggtggatatggaacaggtgaaaaaggctcatcagctgtatctggatcactgcctgggaggaagagacgattctgtggtcatgcagtacttgattcccggctggaaatttgaccccaaaaggccctgtcttgtccggtaatggaaacaggcatgaaaaattctaatgatacaatcggtattagcaattggatttatcaggttttcgttggtataatgcatatatcaatgggccagttgagaataaaaatgagcaatatcgccaaacggagggattaaatggatatggtacaaaaaggtacaccagttgtaacagagatgcaggtcattcctgttgcagggtatgacagcatgctgatgacgttaagcggagcccatgctccctggtttaccagaaacctggtgattttaaaggacagcgcaggaaatacgggaatcggagaaattcacgggggagattacacttgtgaagcattaaaaagctgcgttccccttgtggtgggccagtcaatcggaaaataccgaacaatattaaataacattcataaggcggccaggcgggtaaaagaggatgacggagaaggaatacagaccttggacatcagcaagctgaaatttgtggtaaaagcagaatgggccattgagtgcgcgtttttggacttactgggaaaacacttagggcttcccatgtgcgaactgctgggagacggaaagcagagggataaagtggagaccctgggttacctcttctatgtcagtgataaggagaaggcccgggaaggccttgattatctggatgaaagagacagcaatgatccctggtttaagcttcgccgccaggagatgctgacaccggagcggatcgtggaacaggcccaggtgcttcatgaaaggtatggatttggaaacttcaagctaaagggcggcgttttagcaggggaagaggagatggaggcgatctgtgcccttaaaaagtctttcccaaaggggcggatcaacattgatcccaacggagcctggagcctagaaaaagccattgagatctgtaagcccatggaaggaatactgacttacatcgaagacccctgcggtccggaagcaggatattccggcagggaagtaatggcggaatttaagaatgcggtaaaccttcccgtagcaaccaacatgattgcaacggactggaggcagttttaccattccgctgccttgaaatctgtggatatcgtgctggctgatcctcatttctggggatttgggggaagtgtccgcatggctcagatcttaaatgactggggtatgacctggggcagccattccaacaatcattttgacatcaccctggcagcctttgcccatacggcagcggcagcgcctggtaagccgaccgctcttgacactcactggatctggcaggatgggcagaatctgctggaagatacgccggtcattcaggacggatatttagaagttccggggaagcctggcctgggagtcaccttgaatatgaaacgggtcatggaagccaatgagctgtataacagtcttccctctcatgacagagatgacgccatggcaatgcagtatctcatatccggctggaagtatgactgcaaaaggccggcactggtaaggtaagctatttgcttttcgagagaaaagcggaaaaatatatacatataaaatggaggggtatttcatgaaaaaaaagaatttgaaaaaaagagtactttgtctggcgctctgcttaagtatggcactgatgagtggctgcgggggaggtggaggcgcagcttccggcggaaccaatggttcccagaaggcggcagcagaatccagatttgtgtttgcgggacccaataacatcacccaatgggatccgctgaatgagaacaagacaaatgcttatatgctgtccaaactcacctataacaccctggtgaatccttacggggaaaataactccatacagccggaactggctacagaatggagcgtatctgaagatgggcttgagtggacctttaagctgagagaaggtgtgaagttccacaacggagaagatttcaacgcggattcggtggtggcgaccttaaaacggctgattgataatcccactctggtccatgcggctttctggccctcactggaaggcgtggaagccaaagacacctatacggctgtgattgagctgaaggaaccatggggagcgttgttgaaccagctgattgatactcccatgtttcctcccaaggcactggcagaaaaaggggatgccctctttgagtttaacgagacaaacaaaccaatcggaaccggtccctggatcgccgacaaatggacgcccggacaggatgcggaattcatccgcaacgaggattactgggattggggcgatgacaagagcaacgttgaccggatcatataccgtccggtcattgaagataccacacgtgtttccggcatccagacaggcgatttggatatgatcgatgcagtgcccgtggaacaggctgacatgctttccggtgtaaaaggggtaaaggtggaaaagattttaggttctgccattgttcatctgggattccgatgtgcagacggacggatctttgaagacttaaatgccagacaggcagtgaatcacgcattaaacagagagcttctggtgcagtccattgcaggaggcggatcggcaagtgactggccctgtccggaaggagtcctgggatatgataaggaaaatgccaagattccggaatataacgtagacatggcaaaagacttactttctaaaacttcctatgcaggagaagaaatatcctttatcgcaccgaccggagtatttgcaaggaataaagaagtggctcaggcagttctggcaatgcttacggacgccggatttaaggtgaatttagaaatcatggaaaatgcggctttccaggagcggcgggctgcgggaaattatgatttatacattcaaagatatccctatccggcaggcgatccggactctgtcatcacccagagatggttaaacgatgcccataagtcagggtatgtaaacgaagagatgaatgaaaagatcatggaacagaaacgggaaagcgatccggtgaaacgggaacagcttttaaaggaagtatttgccattgagtgggcccaggcagcacctcatctgtctctttaccagcaggtgacgacccttgcataccgggaaggcattacaggcttaaaggtccggatcgacaatgtatttgactattccagagtgtcaaaagccgcaaaatagtgggtaaagggcacacatcttgaaaggggatacggttttgctgaaatttatattgaaacgtttgggatatacggtttttgtcctgtttggggtatccatcttaaccttcgggcttttaaagcttacaccagggtccccggcccgtctgatgctttccgatgatgccacagaggaacagatcagagaaaaggaaatagaaatgggcttagaccgtccgctgaccatacagtatgtcagttacataacaggagttgtaaagggagatttaggagattccttattttataaaatgcctaattccaccctgatctttcagaggttgccggctaccgcgtatttaacgctggtagccatgggaatcgctttgctcatcagcatccccatggggattatagcgggagtgaagcggggatctgtcatagacttgtttgccatgatatttgcccttctggggcagtccatatcaggtgtggtattaggacttatctttattctgttttttgcggtcaagctcggttggctgccggccatgggatacggaggctttgcatttgtcatcatgccggccacctctctggccatgcagatggcggctctcattacccgtatgctgcggtccggcatggtggatgtgctccaggaggactacattacagcaacctatgcaaagggaatcagcaaccgggaaattacaatgaaatatgccttaagaaatgcaattcttccggttattacggtggtgggccttcaggtggggacattcctggggggagctgtggtaacggaacagatatttggctggccgggaatcggcaccctgacggtccaggccatcgggcttcgggatttcccactggtgcagtccattcttttggtaatatctgcatgctttgtactggtcaacctgctggtggatattatttataccattgttgacccgcgtatggactttaactaagggggattggaatgagcagacaagaattattcagaagaatgcgcaaaagtaattttttcgtcataggagcagtattggtctcctttattattttcatatcgttgatttctccctgggcagcgcctcacgatcccattggctcggacttaactctccggttaaagatgcctgacggtctatccaaaggctggagcggttatattttgggaacagatcctcttggacaggatattttatccaggctcatggtggggagcagggtttctctgtggatctctttttccgtggtcattgcaacggccatcatcggcaccattcttggaattatatccggatttttcggagggatcattgatacggtcatcatgagattcagtgatattcaggtgtccattcccccatgatcctggccgttgcggttatggcggtactgggaaacaccaccaacaatctgatcctggtcctggtgtttacaagatgggtgcagtatgccagagtggtgcggagcaatgttatgggaatccggaatatggagtacattcacgcctcccaggttttgggttcctccaagagaaggatcatgttcacccagattcttcccaatgttctgacacagctgatcattgtcatgagccaggaatttggccgcaccatcctgactgagtcttccttaagcttcttaggtctcggtgttcctgcccctgccccttcctggggagttatgattgcagacggaagagagtatctggcaacggctccttgggtggtggttgcacctggagcagcgcttatgatcgcagtgcttgcatttaactttttaggcgacggtgtgcgtgacgtactggacccgaagaataagaattaaccacgaaagggagaatccagatggaaaaattaattgagatcaaagatttctcagtaaaattcgagacgggccgtgccgtagcatatgcactgaacggggttaatcttacaatcggcaggggagaagctcttggtctggttggagaatcaggcgccggtaagacgaccacagccctgggaatgctcaacttaattccccagccggccggcaaggttacgggcggagatatcctgtatgagggaaaatctgtatttaaaatgtcccagaaagagcttatggacatgagaggcgacaaggtagccatgatattccagaatcctcttacgtctttaaatcctgtatttaccgtaggggaacagatcggcatggttttgcagaaacataagaatttaagcaaaaaagaggccgtcaatgaggccggcaagctgttagaagtggtgggtatagccaaataccgggtcaatgatttcccccaccagttttccggaggaatgaggcaaagggtgggcattgccgcagccctggcctgcaacccttcccttctgatcgcagatgagcctaccacggctttggacgttaccatacaggcccagatcctggagctgatgaaggagcttttggtcaagtatgacagctccctgctgatgatcacccataacctgggaattatagcggagatctgcaacaatgttgcagtcatgtatgctggaatcattgtggagtatggttctgtggaggaggtattcaccaatccctctcatccctataccatcggcttgttcggctccattcccaagctgactggaccaagggaaaggcttgcttccattccgggaacagtggcaaacccggaaaagcttccctcaggctgtcctttccatgaacggtgcggggaggcgtcgggccggtgttcggaacattcgcccagaatgtttcagatcggtgaaaatcattatgtggcgtgccacaaagccggggaggtgaaaagatgaaacctctgattcaggttaaaaagcttaaaaaatattttgaaatcaagggaaagggccagcttcatgctgtggatgacatttcctttgatatctacccgggagagacccttggtctggtaggagagtccggatgcggaaaaagcacggttggaaatgtgatcatgagactccataagccaacgggaggagaactgatttacggggaaagggatgtatttaaagcatcgggaaagcaggaaatgctggagatgtgttccaaaatacagattattttccaggatccctattcttccttaaaccccggaaaaccatccgatccatattaaaagaggcttataagatccataagatcggctctgataaggaaatgaatgagaaaatagaagccctgtgtgatgactgcgggatttccaaggatctgctgaacaaatatcctcatgagctggacggaggaaaacgccagatcgtgggaattgccagggcattgtccttatcaccggaattcattgtctgtgatgaaccggtatcctcccttgacgtatccattcaggcaaccatcatcaatctgctcatggatttacagaaaaaaagaggcttgtcctatctctttatttctcatgacttatcggttgtgcgccatatttcaaaccgtattgccgtcatgtatctgggccagatcattgaaagcgcggaaaccgacgatatctttcagaatgccgtacatccttataccatagctcttttatcggccattccaaaggtggagatcggcaaaaaggtgtcccgcatcgttttaaaaggggatgtgccaagcccgctcaatccgccggaaggctgccggttcgcaccaagatgctggatggcaaaggatatatgcaaaaaagaaacccctgtcctccaggaaacaggagaaaagggtcactgcgttgcctgtcatttctgggaagaatccaggaaaacagctgagaaggaacaggctgcaatggaaaaggcggaaatgctgccaacataatttttaataaaatgccctgtggccttggaaaattccagccatagggcgttttattggaaataattttttatattttcgcagaagctggctccggcctgatttaagatccagttttttctggtcacaagggcattgaacctggtgagccggggagaaacggaataataggccacccgctcccgttcgctggcgcaggattctccgataaaggtgaccccgatccccatggcaaccatgcttctggttgtggatatgctgttggtttcgcatacggttcgtgggatccagttggccttttcaaacacggcatcagtaagatagcgcagagtggagccctttttggaaagcaggatgttttcatctccgaaattctcttcaaattctttgatttttatgggactgcccggattttttctccggtaaggatggccggccggaatggaaaacaatacttcttcctcccgtagtatggtgacctgatcaggggaaaaaggctctgtggtattgagcgccatgattccgcagtcaatgctttcttccaataaaagctttgtgagatctggcagaccggtttctgaaatctcaatggtaacctcgggatagcgggttttaaaggcaggaatgatctccaccagcattctcagaccgaattgggaggtgactccgaccgtaatgtggccccggttatccaggttttgtatgttttggtaaaggacatttttgatggatattaccttttcggcggcctggatataaagctggcctgcaggggtcagggataagcggcctttgctccggtaaaaaagaggcgtgccaagctcgctttccagcttggaaagatactggcttaaggtggattgggagacaaacagctcttcagcggcttttgtcatattttgtttttgggcaatggtcagaatataactgagatagcgggtatccatggcaaattctcctcttcatggcggaaaggttcagggtgtgggttacatagatggtcgctgaataaaattataccataacccttatggaatgacaattctgtatctaaatccatgttttatatgaatccctgtctgttaaaggagtttgatggcacggaggcatgaaaaagagcaaggtacttagctgttcccagccatcccttgctctttcctgtttgatattattttaatgagtctgcaatggcattagccatagcagcaatttcagacagctggtcctcttttacagatgatttgatggtaatggtctgatccagtatggtcatgtttttcattcctgtaaggatttccgtcatctttttgcctgccatgacaccccaggaaccgttttccataagggaaactgtgcggttctgtacgttatgggccttcatatccagaagcagatgctccatgctggtgaagattccaccgttataggtggctgaagcaaataccagatggctgcagcggaaggcctctgaaataagcactgacggatgggtgttggatacgtcatacatgacgatgttgcggatgccccgttcggacaggcggcatgccaggatgttggctgcattctccgtgtttccgtaaatggaaccgtaagcgatcataacggcgttttcttccggtgtatagctgctccatttgaaatacttgtccatataccagcagatgtcagaacgccatacaggcccgtggagaggacaaaggatctgtatgtctaaatccttgatcttctttaaaagggtctgggtggacggaccgtattttcctacaatattggaatagtatcttctggcttcatcaagccattcccgttcaaaattcacttcatcggcaaacaggtttccgttcatggcgccaaaggtgccaaaggcatcggcggagaaaagaatcttgtccgtggtatcgtaagtaaccatcacttccggccagtggaccatgggagccatataaaaggtaaaggtgtgtttgccggaggagaaggtatccccttcttttatgataacagcacggctgtcaacgccgaattcataaaactggttgataatggggactgtcttggcattgcagatgatctttacgtctggataccttctgaccatttcccctaaagtggcacagtgatctggctccatgtggtttacaatgatgtaatccagattccgcccaccaaggactgcttccacattttccatgaactgtccggttattgcccggtcaacagtatcaaaaagaacggttttttcgtccagcaggacataagagttataagatatccctttcggtatgggataggcgttttcgaacagggccagacggcggtcacttcctccaacccagaacaagtcgtctttgatattttttacacaatacatggtgctgccttcctttctttcgttcgtgcattctagtccatcgtatgcagtatactatattttcaggaaaatgtcattgtgttttttaaccggatcaatctaaaacaggttcaatataaacttccacgattccgccgcacaccattccttcgtcttcagcgttgccgggagtcatgtcaaccttctttaataccggcgttttatcccttgcagtttcccttgcaatggcgcacacctcagcttccacacagccgcctccaatggttccgatggtgcttccgtcaagcatcacgatcatttttgagcccacatccctgggggcggaaccttttctggaaacaatggtaacaagtgactttggcatgtccgataattccaaagaggtgagccctccaaggatttcctttggatatccaaaggtttttttgctttcgtttttgacctggatgatctccgccataatggctacggcgatttcttctggggtctgggcattgatttttaacccaatgggagtatagacctggtctaacagttcccggcttattccttcgttctccaggaaatcctttaccagctttactctggctctgctgccgatcatgccgatgtaggcatttttcttgacaatgatctgggataagcagtcctggtcgtggcggtgtcccctggtgacgatgataaagtaatggcctgtacttccctggatctcttccagggcttcccggaagggcttgcagataaccgtatcagcaccttcttttcttgcggtattggcaaaggataccctgtcatcaatcaccgtaacgtgaaatcccagcatttttccgattctgataatggggatggaaatatgtccggccccgcataccaccatgtatttttctcctgttacaaattcgcagaacagagtgctgttctgagatttaatgatctgggttttgtcaaggccttttaaatcctcagaaaaggggtcaaaaaccttttcatccccctgtctgcagataaattccccattggaccacagggctttggatcccattccctgtccttcgatgattgtcaggctgatcaaactcttgtttttatcagcatttgttaattcttcataaaatcctgccattatatgattgcccccttttgctgttgtgtttttgaaagaaaaaagggcgggattctctccgcccttttttgggtattctgcctgtaaagggatctttgctgttgggatccttttattttgctggttttggtttacggtagaaggtattatccaaaggaagtttgtaacggtatacgccatccttcttataataagcattctgtaaagcaggtgctcccataacacatacgatctcacccacaccctttgctccaaatgctacatcagatggattcttttcaatgaaccgtacgtcaatgggcggcatctgaggtgctttaaagagacctaacgtacctaacttggcctgaggaatgccatcctttaacgggaaatcctctgtcagtccataaccaagtcccatagcaactccgccttctacctgtccttctgcggcaagagggttgatggccttaccgatgtcatgggctgcaatgacattcacaacttttccttccgtgtcaataacaaaaagctgtgttgcatatccgtaagcaatgtggctcaccggatttggtttgtcactgcccatagggtctgttttataatcaaattcaccgtagtattccttaccttctaagtcgcttaaggattttcctgcatccaaatcttctttcagctttctggctgctgtgtggatcgcttctcctgtaaatacggtctgacgggatgcggtggtagttccggagtcgggtgtgtattttgtatccggatgtcctacctctaccagctccggtgcaagacctgtagtatgacagaccatctgtaaggttatggtctggagtccctggccgatagcggcagcagaagagcctgtaacaacctttccgtcacggattcttaagatacagcggcctacgtctgcaagacccacgccaatgcctgcattcttcatggcagatgcaattcctacgaaataattgggatctgcttcatatttttcaaaatcttctttcactgcttccagggtttctgccatacctgtgccctcatcagcgatctgtccgttaggcagggactgacccggtctgatggcgttgcggtaacggatctcccagccggatattcccacctgttctgccaactggttgacgagagcttccgtagacatacaggactgggttacgccgaatccccggaatgcacctgcaggaggattgttggtatagtaagcatctccttcaatgtccacgttctggtagttataaggtccgccggcatgagtgcaggctctttgaagtaccgggccgcctagagaagcataggctcccgtatcggagataagcctggcctttaatccctgtatgatgccgctttcatcacagccgatcttacagtagatttccatggcgtggcgctttggatgataattaatgctttcctggcgggagaaggatacttttaccggtctcttggataagtatgcgcaaagtgcagcctggtgctgtacgctcatatcttcctttccgccgaagccgccgcctacgtaagcgctctggattcttactttctccattggaatgccaagatatgcacttaattcgtgatgttcgtcataaattccctgtgctccggtaattacccttacaccgtcaccctcaggaatgccaacagcagtttccggctccatgaaggcgtgctctgttgcaggaacatagaaagtgccttccgctacatacttggaattggcaatggctgtttccgcgtcaccgcgttttaccacttcatgggcgagacggttgttttccggaattctgaatttgccaaattgcatgaagccttcgccgtgaacctgatgggcgccgggaaccatggcttcccttggggaacggattggttctaattcttcgtaatcaacttctactgctttaactgccgcaactgcctgttccatggtttcggctacaaccatggcaagggtatcgccgcagcattttgtttcttcgcccacatcaatcatgccgggccagtcatgtgccagatggccgatatatctgtcccccggaatgtcctttgccgtatagatggccacaacgccgggcatggcaagcgctttgcttgtatcgatgccgttaattttggcgtgtgcatatttgctgaataagttctttccgtaaagcatgccttccatataataatcatctgcatatttggcagtacccagagtttttgcctctgcatccacacggcaggttctttctcccaccttgccggtctgctttaattcaggtatctctgtattttctctaagcatttttgctgccagtaaaatgccgtcttctattttcgtatagcctgtacagcgacagatatttgtacggatcgcctgctttacatcctccctggttggattgggattctggtcaataaggcatttgccgctgatcaccatgccgggaatgcagaatccgcactgaacggctcctgctgccgcaaaagcatagacaaagacatctctttctctctgtgtaaacccctcgatggtctgaacctttttcccctcaagcctggataatttctgtacgcaggcgcggacggtcttcccatccacaattacggtacatgttccgcaggcaccttccttacatccgtttttaacggaggtgataccaagcctgtaacggagaaaatccattaacgctaaatcttcttctgattggtaatccttaccgttgacatttactacaaacatgacaatacctctctctctttatacttagctgatattatataattccgcgcattaattttaacaatactgttttatataattttgttaaaaaatggcgtttttatttcttctcccacaaccatattaacatataaatcatccaaaaacaattcttattccatgaaaatataaaaaatttttagctatacacaaaaaaagttagaacatgcgtttttccgcttaaataaaggactttggcctcttcatttatagaaaatatctataagtggaccttgaaattcaaggtggttattagtgttttcgaaccggctttttatatgctggaaaaatattttaaactttaaaaatattgcaaattttgttgcatatggtataatgaaaaaagactaagatacgatgtcctctgggcttttgcctggaggatgtttttttacacaaaaggtgtggaatattttataccagagaaagaaacgtgaatttttaatggtaagaaactgcaaaaggaggcggaagatgagcggggaaaaagaaaacattctggtgagcgcctgtctgctgggagtcaactgccgctatgacggcggaaacggcaagcgggaggatttgatcgcccttatggagaaatacaacttcataccggtctgcccggagcagcttgggggcctggaaacgcccagggagcctgcggagcagattggcggcggtgagacagggaacccacatgggatccgtgtggtggaccggtcaggaaaagatgtgacggactgctttgtaaagggagcaaaagagacacttaagctggccaggctttacggctgcaagcgggctgttttaaaggaacggagcccatcctgcggccatgggtatatttatgacgggacgttttcagggacaaaggttttgggaagcggtgtgaccgcaaggcttttggaggaaaacggaatccttgtatcaggagaaaccagcatagggtccttttaaaggaaccgaaaggcttaacatttataaatataaaagaaagaggaggcactatgaaaacagcaattacaagacaacaggcactggaattacttatgaaatataataaggagccgtttcacttacttcacggactgacggtggaaggggtaatgcgctggtacgcaggagaaatgggatttgggtcagaggaagaattctggggaatcgcaggccttcttcatgatgtggattttgagcagtacccggaggagcactgcaagaaagcaccggagcttctttctgagattaaggcggaggaagagctggtccacgccatatgcagccatggctacggcatctgttccgatgtaaagccggagcatgtgatggaaaagatcatgtttgcggcggatgaactgaccggtcttatcggagcggcagccaggatgcgcccttcaaaaagtgtcatggatctggaagtatccagcttaaagaaaaaatataaggacaagcggtttgcggcaggctgttccagagatgtgatcgcaacaggagcagagaatctggggtggacgcttgatgagctgtttgaaaagaccattctggccatgcgctcctgcgaggataaaataaaccaggaaatggaagcgtaattttatgcataaaaatggaaaaatatacacgaaccgcgaaaaatacttgacagcgggtggcaattaggatattatttccgttaaatatgtataataacctgtatcagaggagaaaagcgctatgaaaaaagttgtgaaattcggaggaagctctttagccagcgcaaagcaatttaaaaaagttggcgacatcatccgcgggataagagcagacggtttgtagtgccgtctgcacccggcaaacggaatgataaggatgaaaaggttacggatctgttataccagtgctatgatgcggcagcagatggaaaaagctataaaaagattctggaaaaaatcaaggaacgttatgtggagatcatcgatggtcttgacttaaacttaaatctggatcatgagtttgagaccattgaagaaaatttccttaaaaaagcgggccgagattatgcggcttccagaggagagtacttaaacggactggtgatggcagagtatttaggctacgaattcattgatgcggctgaagcgatcttctttgatgcagacggaacatttaatgcggagcttaccaacaaggagcttagtgagcggctggagcatgtggaacgggcggtaatcccgggcttttacggatcaaagcaggacgggaccattaagaccttttccagaggcggctctgatgtgacaggttctattgttgcaaaggctatccatgcggatatgtatgaaaactggacggatgtttccggcttcctggtggctgatcccaggatcatcaagaaccctgaggtcattgagaccattacataccgggagttaagagagctcgcttatatgggagccagcgtccttcatgaagatgccatatttccggtgagaaaagaagggatacccatcaatatcaggaacaccaataagcctgatgataaagggaccctgatcgtggagagcacctgcaggaaaccccattacaccattacgggaattgcaggaaaaagaggtttttgctccattaacattgaaaaagccatgatgaacgctgaggttggctttgggagaaaggttctggaggtatttgaaaagttcggcatttcctttgagcatatgccgtcaggaatcgataccatgaccgtatttgtccatcagtcggagtttgaagagtatgagcagtccgttatagcagggatccacagggcggtagagcctgatttccttgagatggaatcagaccttgcgttggttgcagtggtgggccggggcatgaaggccaccagagggactgccggaagaatcttttctgcccttgcccatgccagggtaaacgtgaagatgatcgaccagggctccagtgagcttaatatcatcattggtgtgaaaaacgcagactttgaagaagccattaaggcgatttatgatatatttattaccaccgaggtttaagacagaaagacaggctgaaaggaagtacttaacagcctgtctttttctcttctgttcccctggcagagctgcagaaaaatggggaaattgctctatctctttattttcctatggccggatcagatacatcctggcttcatatggcttaagcacatctgccgggccttcatccctataagaactggccagcagctttttctcacggtcaaattcttcaggaagctgcagccgcaccgtattgccataaaagttgcaaatgacaagcaagactgtttctttccgtgtgcgggtataggcaaagatgtcaggatcctccggcagcaggagccggtattttccgtctgcgaatacatcataggttttccttagctcaatcagcttctggtaaaggtaaaaaacagaagtttcatctgcaagtgcagcctctgcattaatttccttatagtttggattcaccttgatccagggagaaccctccgtaaatccagcttccctgccttttgtccactgcatgggcgttctggcgttgtccctgccttttgcatagacagactccataatatcctcttctttgtatcctgccccaattctttcccggtacatatttaaaatctctatatcccggtagtcttccatgtcataccttacattggtcattccaagttcttcaccctgatagatataaggggtgccttgcattccgtgaaggagtattgcaagcatcttggccgattccacccggtattccttgtcatttccccatcgggatacaattctcggcagatcatggttgttccagaacaggctgttccagcccttgcagaaaagtgcttcctgccaggtggataagacacgttttaattccaggaatgggagaggagctaagtcccatttttcaccgcctcttttctggtcaaggcagatgtgctcaaactggaataccatggaaagctcccttccatccgggctgctgtaaagcagggcattttccggatttgcactccatgcttcacctactgtgacaagatcccctttctgaaaggtttctctgcttaactcctgtataaagtcatggagcattggcccatccgccgtgatcagccggtccggatcctttgccacacagtcgatgacatccagccggaatccgcctgcccctttctccatccaccaaaggatcatatcccggatttcccggcgcacctttgggttttcccagttaaggtccggctgcttcactgaaaactgatggaaatagtattgtcccagttccggaacccactgccaggcagggccaccaaaagcagcccttaatccatttggaacgattccttccaccccatccctccacacataataatcatgataagggttttccttgctttttatcgcttctttaaaccatggatgttcatcggaagtatgatttaaaacaagatccatgatgatgcggattccccgtttgcctgctttttcaatcagttcctccatgtcttccaggtttccgaacatgggatcaatatcctgataatcggatatatcatacccattgtcatcctgaggggaacaatatacggggaaagccagagagcatctgcccccagcttttccagataatcaagcctggaaataatcccctgaaggtctccgatcccgtcaccgttgctgtcctgaaagcttttgggataaatctgatatatgactgcttgtttccaccattttctgtccattttctttttccttccgtcaagcttttacagaaccgctggtcactcctgcgatgatccatttctgacaaaaaacatataccgctaaaattggcagcagaaccattaaatacgaggcaaaggcaagattatactgggtggagaactggcctttaaacacatactgggcaagctgcagggtctgctggctggcatcgctcagcaaaaccaggggcatgagaaaatcattccaggtccacataaaggacaggatcgccactgtagcgctcattggcttaagcaggggaaatataatccgccaaaaggtctggaacgtatttgccccgtcaatccttgccgcctcctccaatgcatggggcagggatttgatgtaccctgaataaagaaatgtattcatgggaagtccgaaaataatataaatcagtgtgatgccgtaaatgttatccaaatgaaaagaggaggcctgtttgaccaggggaagcataatcacattaaaagggataaacatggcgctgataaaataataatacatgagattgaaaaacctgcttttatccttgtttcgtataatggcataggctgccatggaattggtcaggatggtaaacaccagattaatgtctgtgataaaaaatgtattgaggaatttccttggataatcggtcagctcccatgcctttgaaaaattctcaaagtgaagggaagacggaagcgccagtatatgttccatatctgacggtgatttcaaggcaatcacaacagtaatataaagggggcccaggataactaaaacagcgattgcggccaaaaggactgtcaggggccaattgatcttttcttttcctgtcatcagtttattttcgcctcccttttttccaatatcttcagctggagtacggaaatcgccgccacaaccagaaataaaataacagcattggctgactggtaggcaaactgtccgccgtcaaatcccctcttatagatcagcatggaaatcgtagtggttgcggttcctggccctccccctgtcattgccatgatctggtcaaaggccatgagaaagcttttgacgcttaataccatatttatggtaaagaagggggcgatcaatgggaaagtgatccaaacaaaccgctggaggccaacggcaccgtctacggatgctgcgtcataaatatccttatccactgtctgaaggccggagagatatatcatggtgttaaaggccatggcctgccagacagtaacaaataaaacacccagccatgctttgccggttccaaggatatttacgcttaagccggggattcctgccattttcccaaaccctggaaggatattgccgaagataaagttaaatacaaagccaatgattaaggttcccagcatatacggcaggaaatagagtgcctttaaaagattcttacccagaatttttccattgagcccgcatgccagagccaggcttaaaacgttgacaaggactgtagcggaaagtgcaaactgaaaggtaaagccataggcctgcttaatggaaggatccgtaaaaaactgcaggaagtttttaaacccgataaattcccagctcccgtagcccttccagttggtaaagctgtaaaaaataccctttaaaaaggggaccgtatggaatagaaagaatagtactgccatgggaactaccataagatagaacgccgggctgatatggttatttctatgttttttcaacgtcttatcctccttttgcctggtttaccgggtattgaggatatcgtattgttcatcgcattttttcagtgttgcggcaatattttcgctttcatccataccgtttgccctgtttaaaaagaactcagataaaattgctgacagattatagccgttggggtaataatggtctacaaaatccgtaacctttccatcggcaatgtccttggccagaccggcaacggaaggttccttttgcacaacgccttccaccggagagaatgcaaactgctcatctatgtatagctggctgttttccggctccagcaaaaatgccacaaaacgtttggctgcttccgggtttttgcactggtttgtcaccataagcataacgtcaatgccggatacaaccttgtttttactcttatcattggttgcgggataagcaaacatatccagattaatggattcattggttttcttgatttccggtacggtccacacgccgttgatcagcatggcggcttccccattggcaaagctgcggttgccgtcatcataggaagttcccataaaatccgtctgggcataatccaccagcttgctgtatttttccaaaacttcctcgtgggtgcccaaaaaggttgctgttccttctttctttgcatctaaaaacccatcaggctgtgttgccggtgccagggagttccaggagggaaggatggtccagttgtctttaaagcttaattcaaagggctggattccggctgcagacagcttttcacatgcctccatcagctcatcccaggtttcaggaaccgatatgcctgctttctgaaacagatctgtattgcagataattccggaagcattggcagcaaatgggatgccgtatgccttttcttctttatccccattgatatcataaaccatctgcatgtaagaactgtttatggtctttaaaacctcctggtcgcttaaatccagtaagattccagcctctgtaagctccgtataggtgttgtcaccgccataggcgatgagatccggcaaatcatctttggtcatcctggtctttaatacggttcctgcatctgccggggaattgagggtaacctggacatcggtgttttgtgagttgaatttgtctacaagcttttgcatggtggatacattttccatttttgaagaaaaaaattccagctgtgtcactccggaatcagaacttttgcctgaggttttgcctgcctcgctgcatcctgcagccatcaccgctgctaaggagcaggttaaaccaactgccaacattcttttcattttcatatacatcatctcgccctttctgtttccttgttatttggtagtaccagtatacaaaacaaattacagccttctgtataaggtatctgagatgttttgtaaaactttttttaccttttttcttcctgggcgcgatattgctcggggtcatctggtaaaggcgtttgaaggtgtggataaaataggaggtgtcattatagcctacataaccggcaatttcgtttattttaaaaaccgtattctttaaaagctcctttgcccgttccatgcggcagttgattaagtatttggaaaaattcatccctgtctctgatttaaacagacggcttaaatagctggaattcataaaatacttgtgggccgccaattcatttaaggagatttcgtaccggaagttaagggatacgtaatttttgatttcctcaatgatgcttcctttttcctcctgagaaccgcaggtgttttccaggattttaaacatataccgctcaagctcctgtctggtccggaactgataaaggtcagatttaaaggaaaataaaagataccggtttacctcttctgattcagaagaggcctccctgctgcaataggccctgctgataacagaaaagatctgcatgataccgctgtatagggaatatacattccaactggccttttcacatttttcaaaaaactgacggagggcagactctgcctgtgggcagctgccttttatcacgctttcgtaaatagccagttcctcctgctgggtcaggatctgttccatggtaagctccggttcgtattcaaacactctggtcttttcgtcaagcaatcttccgttgatggcatagacacagtccctgtaagcgtctccaagctgctcttcctctttataaactctgctgattccacaggtgatttccacatcccattgagacagcgcctgttttaaccggcgtataagcctttgatccggaagctcctcctgattgtcaaacttcatggcaatcatctcgtccggctgctggaaataaaagacctggatatttccgtaatcagatgaggtttccaggaattctgacagcttttttgcttcctccctgctcatgcgctgctttccctgaaataagaacatctgataggagcgttcctttagctgtccgccgcataaatcacggaaggtatccatcaaagccctgtttgccagaaggccggagatattcacatattggagggattcctgcagcagcctccggtccacctgcttctcaagcagccttttcttctcttctctggcctttgtaatatcccatatggccttttccagctcctccggttttaccggcttggtaaggtaataccggactccatatttcatggcttccctggcgtaattaaaatccgaatagccgcttactattattacatccgttgccggacagttttcttccgcatattttgcaagggacagtccgtccatctccggcatgcggatatcggtgatcacaagatctgcgtccccggcggcaagataatctgccgcctgttttcctgtttcggcttccagacaaacggttatatccatattgatgctggttaaaagtttaacgagcattttctttgcataatattcatcttccgcaatgatgaccttcattttatctctccttatttcgcctgatccgcatatgaatgcaggtaaagcttccgtaccggctttccaccacaattccgcaatcttccccataatagtttttaagccttgcatttacattggctaacccgatgcctgatccgtcttcccccagcagggcgttggcttttgtactccgtaacgtctggtttaattccgctatcttctcatccgtcatgccgcatccgtcatcgtacacggagatcataagataatcttctaaatacggtgatagggagatctttaaacagtccttgtcccgttttgccttaaatgcatgttgaatggagttttccacaatgggctgaaggatgaatttgatcactccattattttcgtattggacgggaatatcatattccaccgcaaaacgcccaggaaaccggatggactggatgcggatatagttctttacctgaatcacttcatcctttatggttacaaagtcagtccctttgatgttatagcggaacatatctgacagactttccgtgattgccgggatttcttcaatatcttccagacgggctatggctgtgaccgtgtttaaggcattgtatagaaaatggggattgatctggaactgaagcattttaagctctgcctgcttttggtttaactgcataatatacagcttggtaatgctgtcattgatcctctttcccatttcattgtagatttcaatcaggttgccgatctcatcctcccttggctttaatccatgtaaaagctttacttctccctgcctcgcctggctcatggtttgtgccagggccttaatgggccggctgacctgcttggataatatgaagcttaagatcccggctgcagtcaggatcagcatcacccatgccatgacattgagcatactttccatgctggtgttgatcagcaggtgttttgggatatactggaccagataccagccggtggattcattttttaagacagcggcaatgcagagggtatcatgaagataaagctccccggatctctttcccgaagcctcgatctgttccagctgagggaaggcttcctgtttttccttttctgaaaggccggtctccagattgatgtgagcgtttctggagttatagatgacctggtttttgtatacaatggcaaaggaggaggccagaccgtcggctgcatccgtggaattaaaatcttttgcaatggatccgaaatctaaatctgccaggagatatccataggctctgtactggccgatatctgaaagctggtggcagactgttaccagggaatagccggtattacctattttctggggataagggattgtgtagtatttctggctcttggttttccaatcaacacctttgattgttttccaagcgctttctatgtaatcctctgatatgttgttgatgctgcaatagatgtctcctgaagcggtcagtatggtggttctttgaacatgggggttgatgaccgtgagcattttaagaacggtctgcatgtaatagtctctttcataacggtcttttggagacatattgctggctttttcatggagtatgacattgaccttgggatcgatcagatgaagaaggtttaaggagctgttatttcccatggcaatatctaagttcatgtttttttgctggttggactgtttcatgtattcaatattgtaggtaagagccgaagagactccttgtatatagcagatggcgaaaataacaacagtaaaaagaagtaatagtaaataagtaagaagtattttgaactgaaaggataatcttcggaaacgtctgagcatagtattcctcctgatattctggcttgggttacgtttctaagtgtactataaacacaaccgcttgaacagtatgcttttacttgaatccccttacctccctgtgttatgatacacgtaaaataccgtatttttaaccgaatcaagtaagcagcgaagcggattgagaatatccgcttgacttcaaggcgtaaaagcagccgggaaatgaggataatcatgaatccagagataaaatccagattaaaagagggacgtccccacggcaccagttccttcccctgcgggatctaccggacacagtcagttcaaaagggtatgatagtaaagcatcactggcacgaggaaattgaaatgatccactttattaagggacattttcgtttactggtcaatatggaatcctatgaaatccatgatgaatgtattttttttatcaatccaggggagcttcatgggatcatcagcgaatccaaaagttttaatgaggagcacgccatcgtgttccagccgggacttctcagctttgaagcttatgactccgctcagatgtacttgatcaatcctttaaaaaaccaggagctgtcctttccaagatgcctttacccggatcatccgtcttatgcttccatcctggattgttttaccgatgtgactgattcctttggaggagaggaaggcttagagcagcagggagatgttgcaggtgcggttatctcccagcttcagataaaggccgcccttcttaaaatgcttgctacgctgttccgattccacctttattccgattctcaccgcagcacagacacgagggtagaactgatcaaagcctccattacctttatcagaaaccattacagagaaaagatctatatccgtgatctcgcttcccttgccaatatgaacgaacagtatttctgccgtttttttaaaagggctattggcaggacgcccacggaatacatcaatgattaccggatccggaaggcaatttcccttctggaaaccacgaatctcccggtcatgagcatatgcctggactccggtttttttaaccttggaaacttcttgaaaatatttcgaaggtataccgggacgactcccttacaatatcgcaaggaaaagtcaaaatagtgaattttttaatcatagaagcgtaagacaaatctctttcttcgaggtagaataaggctactacagaaaagagaggttgcatacgatgattaagaaatggtggcatgataaaacagcttatcagatttatccaaagagctttctggattccaatggagacggcataggagatttaagagggatcatccgtaaattagattatttgaaggatttgggtgtggatatcctgtggctttccccgatctacgtttcaccccttgcagaccagggatatgatatagctgattattacaacatagaccccaggttcgggaccatggaggacatggaggaactcattgaaaaagcgaaaaaaagagagatgtatattgtcatggatctggtggtaaaccactgctccgacgagcatgaatggtttaaaaaagcgtgtgccgatccggatggcgaatatggaaactacttttatatccgtgagaaaaaagacggaaaatctcctactaactggcgttcatacttcgggaattccgtgtggagcgatattcccggtaccaataaacagtatcttcactccttccataaaaaacagccggacttaaactgggaaaatccggttgtccgggaggaaatttataaaaatatcaactggtggctggataaaggcttaggaggtttccggatcgatgcgatcattaacataaaaaaggcccttcctttccaggattaccagccggaccgggcagatggtttatgcagcatccagacaatgctggcccatgcccatgggatcggtgagtttttaagcgagatgcgggaccggtgctttaagccccatgatgcttttaccgttggagaggtctttgatgaaaaaccggaggaattagaatcctttatcggtgaaaatggttacttttccagcaaatttgattttaatgaaaccgtattcggcggaagtgaaaagggctggtatgatgccagggcgattactgcggaagattataagcattgctgttttgctgcccaaaagcatgtaggtaccaccggctttttatccaatatcatagaaaatcacgatgagccaagaggggtcagccattaccttcccgcaggggaatgtgctccggaagcaaaaaagatgctgggcggcttaaactttatgctccgtggtattccctttatttatcagggacaggaaatcggaatggaaaacactgttttttccggcattgacgaagtggatgatattgccaccctggaccagtaccagaccgcccttgaggcaggatatgggccgaaagaagcgctggatattgtaagccgctacagcagggataatgccagaactcccatgcagtgggaggcgtcggccaatgcaggctttacggaaggaactccctggctgaaggtgaacccgaattataagaatatcaatgcggctgaccagatttcccgtaataattctgttttcatgttctataaagagctgatccggttaaggaaacatccccagtggaaggaaaccataatctatggaaccctggaacctgttcttgaggatgaaaagaatcttatggcttactgccggaaagggccaagaacacttcttatcattggaaattttcaaaaagatgcacgggaaattatccttccacggataccagaggcagttttgatcaataactatgaggaagtaagtcttgatgaggacaaagtaactttaaagggctggcagttccttgtgatggaaatttgaaacaagtgagaagctagcggcaggattacttagttagaaaggaaataccatgaatcaaaaagaaagaatgctcgcagggctgccctataaggcatggctggatggactgcctgaggatcggctggaaaataaaaagaagctgtatgcgtacaattcattaagcccggaagaagaaaataaaatggacggactgatccggctgatccttggcaaagcagggggaaatgcacacattgaaccgcctttttactgtgactatggaaaaaacattgaggtaggaaagaatttctttgccaattataactgtaccattcttgatgtgggcaaggtggtgatcggtgacaacgtaatgtttgctccaaacgtatccatttacactgcgggtcacccggttcatccggactccagaaattcaggctatgaatatggaatatccattaccattggaaatcaagtatggatcggcggaaatacagtcatcaatccaggtgtgacgatcggcagcaatgtggttattggggcgggaagtgtggtgacaaggaacataccggataatacaattgccgtgggaaacccctgtaaggtgcttcgggaaatcagcgaggacgaccggaaatactattttaaggacagagaatttgatgtagaggattaccggtaaggtgaagattcccattaagaaggaatctgccggggataagagataagaagcagatcggcgttgatactcatgataagaaatgggaatcaacgctttttaatatcattgacttccgggggataccctggggttcgcccccaaccggataatttgccgtctgagcatggtaatttattaccccaattaagaaaaaagtctttggcaggaatgtgaattatggtacaataaagatagaaacggccgcaggaaagaccgcaaaacatagtatggggaggaagattatgcagtatcgtaattttggaaaaacaggaataaaagtatcggctcttggatttggagccatgaggcttccgatccttcaggaggaacaggtagatgaaaagcgggcggtatccatgatccgccatgccattgatgaaggggtgaactacattgatacggcatatccttaccaccagggagagagcgaaaagatcgtgggcaaggctttaaaggatggctaccgggaaaaaacgtatctggccaccaaatgtccggtatggaagcttgaaaagccggaggactttgatgaggttctggatgaacagcttagtaagctacagacagaccatgttgatttttatctgcttcatgccttgagccgggatcgttttgaagacaaggtgaaaaaatttgatcttgtaaaacgaatggaaaaagccagagaggacgggaaaataaagtatcttggattttccttccatgattcatatgatgtatttcaggatatcctagattattatgatggatgggatttttgccagattcagtataattatgtggacttagagcatcaggccggattaaagggattaaaggccgcggcaaaaaagggacttgcagtggttgtcatggaaccgcttttaggaggaaagctggcggatcctgcggaccatgtgaaaaagtcattccctgatgaaaagtcacctgtggaatacgcccttgattttttgtgggatcagtctgaggtgagccttctcttaagcggaatgagcgacgaaaggcagctggaagaaaaccttgtgtttgcagaccgcagccatgtgggaatggttaagtcagaggaaaagaaggcctataaaaaggcaaaggagatatttgattccatggccctggtgggctgcaccggatgccgttactgtcttccctgtccatttggcctggagatcccggatattttttcattttataatatgactgctgcccataaagagagggaggcaaaggccggatacgaggccatgtcagtaaaggcagagggctgccgggcatgtcaccattgtgaaaaggagtgtccgcagatgataaccatcagtcaggtcatgccccaggtggcaagtgtgtttgcaaagctttaagcttaactgtatagacaaaggagggacggtttatgctggagaaaattgatttatcgaaaaaaattgacaaaaaaacctataaaaacacaataaaggagcaaagcgaaaggctgggcctcttgcagcgggaatgcaaggattccggaattcctgttatgatcgtgttcgagggcatgggagcgtctggaaaaggaacgcagatcaaccgcctgattcaggccctggaccccaggggctttgatgtatacgccaacgatagatcaacggaagaggagcggatgcgcccgtttttgtggcgtttctggaccaagcttccggcccagggacgaatcgccctctttgacagaagctggtaccggcaggtgaccattgaacggtttgaaggaaagatcccggaaacggtccttccggagacctttcatgatatccagagctttgagcgtcagcttactgatgacggcatggtcattataaaactgttcctttatatttcgagagaggaccagaagaatcggtttaacaagcttgaaagctccaaggagacagaatggcgggtgacaaaggaagactggcgaagaaataaggagtatggccgttatctggcaatctgcgaggaaatgcttgaaaagacggatacagactatgccccgtggacgatcatcgaagccactgacagggattttgcctccgcaaagatcatgacccaggtggcggactgcttagaggatgccttaaggcagcgggagttaaggggagagagaaaggaaaaggaagtgccggtccgctctgagaaataccagaacggagtcttatccggtgtggatttgacaaagaccatcacaaaggaagattataagaaggagatggaacggctttgggaaaagctggaatccctgcacagccagatataccggttgagaattcccgtagtattaggctttgagggctgggatgcggccggtaagggcggtgccatcaagcgtcttaccagccatttagacccaaggggctataaggtgtatcccacctcggctcccaatgatctggaacgggtccatcattacctgtggcgtttctggaaccatgtgccaaaggcaggccatatcgccatttttgaccggacctggtacggccgggtcatggtggagcggatcgagggcttttgcagtgaaaacgagtggaagcaggcttaccaggaaatcaacgaaatggaaaaccacatggcaaatgccggagcagttgtgattaaattctggcttcatattgataaggctgaacaggaaaaacgctttaaggagcgccaggaaaacccgtcaaagcagtggaagatcacggaagaggactggagaaaccgggaaaaatgggatcagtatgaagctgcggtcaatgagatgctggtgcgcacctccaccacatatgctccctgggtggtcgtagagggaaactgcaagtattatgccagagttaaggtgctgaaaactgttgtggaagctttggaattaaagataaaagaagtaaaaaattcgtgaccgcttgttttttcactctttttcgtgtaaagtagaaaacgcccacaggaatgctattatgccctaaaaagcgggcagaaaagaggaaacccctttcagggataccattatgccctgaaaagcgggcagaaaagaggaaacgggatgagtacggttttgatcgtgggcggtggcgctgcagggatgctggctgggatagcggcagccatgaagggcagtaccgtccacatttttgagaaaaatgaaaaacttggaaaaaaagtctatatcaccggcaagggacgctgtaatgtgaccaatgcctgtgacacagaagagctgttcggcaacgtagtgaccaatgccaaattcctttacagcagcttttacggctttaccaattttgatatgatggacctattggaaggacttggctgtcctttaaagacagagcggggcaaccgggtgtttccggcctcggacaagtcttcggatgtaataaaggctcttacaaaaaggcttttggaccttggagtttccattcattaccgcaaacaggcggaaactcttttgatagagaatggagtcctttcaggactggttttaaaggataacgggaaaaagacaaaggtgtacggggatgcagtgatcgtagcctgcggcggcctgtcttatcaggccaccggttccactggagacggctatgagatggcaaaggaagcaggccacccggtcacctctctttcccctgccttagttccctttgtggtagaggaacccatggtaaaggaactgcagggactgtctctgcgcaatgtggaggcaactgtattaaaggggaaaaaggtggtttataaggagttcggggaaatgctgttcacccattacggggtcagcggcccggttcttttaagcgccagcagttatgcggtaaaggagttaaagaaagggccgctgaccctttccattgatttaaaaccggctcttaccgaagaacagcttgacgccaggatcctgcgggactttgaagaggctgccaacaaacagtttaaaaattccctggatcatttatacccttccaagctggttccggtcatggtggatgtgagcgggatctcaccagaaaaaagagtcaatgagatcacaagggaggaacgccagagactggtccgggcgaccaaaggctttctcttaacgcttacaggacttcggggctacaatgaggccatcatcacccagggaggcgtttctgtaaaggaggtaaacccctccaccctggaatccaggcttctttccggtctttattttgcaggggaagtgctggatcttgatgcggtgaccggaggctttaatttacagatcgcctggtctacgggatgggcggccggtagtgctgccggagaggagaaattcaaaggatgaaaagagtttataatatagctgtggacggaccggcaggggcggggaagagcaccattgccaaatctgctgcagaaaagcttaactttgtttatgtggatactggagccatgtaccgggccatggccctgcattttttaagaaatgggataccggcaggggatgaggcagctgtttctcagtcagccaaagaggtggatgtgaccatttcctacgaaaacggggtgcagcaggtgattttaaacggggaaaacgtttcgggacttatccgcagttcggaggtaagcgccatggcttctgctgcttccgtctatatgccggtccgggaaaagctggtagagcttcaaaagaatctggctttaaaggaaaatgtcattatggatggccgggacatcggaacctgtgtccttccccatgcggatcttaaaatatacttaacggccagcagccaggtccgggcccagaggcggtaccaggagcttgcggcaaagggagaggaatgcagcttagaagaaattgaaaaggatattatagaacgggattaccgggatatgaaccgggagaattctcccttaaagcaggcagaggatgccgttcttgtggatacttcccatatgaccgttccccaggtggtggaccggattctggagttgtttcatgaaaaaaggatgaaagaatagagattttccatcttgattcattgggaggcaaaatgaaaggaggcagcttatggaagtgatcgttgccaaaactgccgggttctgctttggagtaaagcgggctgtggagcaggtttatgaacagttaaaaagggatgacaagcccatttatacgtatggtcccatcattcataatgaagaggtggtccgcgatttagaggaaaagggagtaaaggtcatccattccgaggaggagcttgaaaaggtcagggatgcagtggttgtcataaggtcccatggggtaggaaagcggatttatgagatccttgaaagaaacggagtcgagatcgtggatgccacctgcccctatgtgagaaagatccacaggatcgcccaggagcagaatcaggagggaagacggcttgttatcatcggcaatgaaacccatcccgaggtagaaggtattaaaggctggggaaatgacaatactttagtggtggaaacacccgagcaagtggaaagtctgcctttatcggaaggagaaaagctgtgtattgtatcacagacgacatttaattacaataaatttcaagatttagttgaaaaaatttcggaaacgaggtatgatatacttgttttaaatacgatttgcaatgcaacacaggaaagacaggtggaagcaaagcggatagcttcagaagtggatgccatgattgtcattggcggaaaaagcagttctaatacccagaagctgtacgatatatgccgaagggagtgtaagaatacttactatatccagacactaggtgatttagatcctgattgtggaaattctgtgcgcagcgtaggtattacagccggggcttcaaccccgaattatattatcgaggaggttcatactaatgtcagagttaagttttgaacaaatgttagaagaatcattgaaaactatacgtacaggagagatcgtcactggtaaagtcatcgacgtaaaagaagatgaaatcgtcttgaatataggttacaagtctgacggcatcattccgcgtagtgagtacacggataaccagaatttagatcttacaactgttgtacaggttggagaagagatggaagccaaagtcatcaaggtaaacgatggcgaaggtcaggtagccctgtcttacaagagattggcagcagacagaggcaataagagattggaagaagcatttgaaaaccacgaggtacttactgcaaaagttgcgcaggtacttgacggtggtttaagtgtggttgtagagggtgcaagagtcttcattcctgcaagtctggtttctgatacttatgagaaggatttatccagatatgcagataaggagattgaattcatcattaccgaattcaacccgaagagaagaagaatcatcggcgacagaaagcagatcatggttgctaagagagctgagctgcagaaggaattatttgaaagaatccatacgggtgatgtcgtagaaggtaccattaagaatgtaaccgattttggcgcattcattgaccttggcggcgccgatggcctgcttcatatttccgagatgagctggggcagagtagaaagcccgaagaaagctttcaaggccggagagaaaattaaagttcttgttaaggatattaacggcgataagatcgcccttagcttaaaattcccggagacaaatccgtggaaggatgcttcatcaaaatatgcagtaggcaacgtagtaagcggaagagttgcacgtatgacggatttcggcgcatttgttgagctggaaccaggcgttgacgcactgcttcacgtatcccagatttctaaggagcatgttgataagccggcagatgttcttgcaatcggtcaggagatcgaagccagagtcgttgatttcaacgaaggcgataagaagatcagcttaagcatcaaggctcttcagtcacaggatgatgcctcaacagaggatggcccggtatattctgacgaagtttaagcataatagataatagataaaacaaatgaggaagtggagagatccacttcctttttatgatgttggaaaacctgtagaaagaaaagaggaacaatatgaaaaacaggatcaatttctgtctggcggccattgcagtgctgtcttttctcatatcagggtgcgggaaaaaaatggagacacagccggaacagacggcagcccagcctgccaatgttacgggggaagcgtcaggcggggtgaggctggaagatgattactatgagtatgtgaaccagcatcttctggaccaggcggagataccaaaggattccagcagctggagctatttttatcagctggacaaggatgcctacgaggttttaagcgaggtgcttaatgaggcggtgaaggaccggaaagcgtcggagcctggttccctggaacaaaagatcgcagacttatatttaacagccatggatatggaaggccggagaacggccggttttggacagcttaagccttatatggatgagataaggaatgcttccggcatcaatgattatttaaaaagtgttggaaacgcctatagagatctgggggtgggcagcattatcacggtgcagtggatggaggatatgagtgattccagccggtacgccctgtatgtggatggggccgatttagggcctgggaaggaaaccctggaggaccagacacaggaaaagctcatggaccagtacaaagaatatataggaaggaccctggagtatacggggcagagccgtgaggaggcacaaaaagcggctgctgaaattctggctttccagaaggacctggctgaaagcgccctttctttaagccagcaaaatgaccctgatatcatatacaatccttattccgtggcagcgctaaagcctttgttttcccaaggtacagtggattcctttcttacgtcagccgggctgggggatgtggattcctttgtggtgacccagaaggagcagatgaaaaagatcggccaatatctgacagaggagcacctttctcttttaaagaattattccgtattctgcctgatcaatgatttcgcgccttacctcactcctgagatcaggaataactatctggattggaataatgtacaaagcggcgttaaggagagaaagaccgacgagaaaatagccggtgaaatgacccagaacatgcttggctttgaatttggaaagctttatgtggaaaaaagtttttcccaggatgataaggcggccattgaagaaatggcacgaaaaatccttgaggcttacaaaaatcagatcatgacccttgactggatgggagatgaaacaaaggcggctgccgtcaaaaagctggacaacatggcccttaagatcggatatccggacaagtggcccgatgattatgggaaggcttccgtcatacccgctgaaaaagggggaaacttaattgacaatattctgtcccttgtaaaggcaaaaaccgatgtaagccgggaaaaggtccgccagcctgtggacaaagcggaatgggggatgacgcctcagacggtcaatgcctattataaccccaccggcaatgagatcgtatttccggccgccattttgcaggctcccttttatgacccttccgcagaatatgcctccaatctgggcgggatcggatctgtcattgcccatgaagtcagccatgcctttgattcctctggttctctttatgacgaaacaggaaattaccatgtatggtggaccagtgaagacagggccaaatttaaagcattagcggatggcgtggtggcatactatgacggacaggaggggtataagggccgtatggttaacggagcccagactttaaatgagaatattgcagatctgggttccatggcctgcatcacttctattttaggggatgatgcggaaagtttgcggctggcctttcgtcaatatgcgacaatatgggcggccaagtatactcctgaaaccatgatcaaaaggctgaacacggatgttcattctccggccagggtcagggtcaatgcagttcttggcgccaccgacgctttttataaggcttatccggaaattaaggagggagacgccatgtatgtggcccccaaaaaacgcgtgaaaatctggtaaagccataagagaaaaccatgatatgcccggagggtttccggtatgtcatggttttttgttttttttataatatcgacagaaagatttaataaaaaacttgacaacagacgtaggttagtgtatactaacttttgagtaatgggaatgattctcattaataaaatgaaagaatgccttacaggtatccctttactcccggtaaagcgggagccctgcctgaaaagcatgaacaataaaaagaaagaagatgatggatgatgcctttgacaatggtgaaaacaggggaacccaacgtaatccgtaaggtgggcggcaaggaagaaacaagacgttttttggagaatctgggctttgtgtccggaggagtcgtaactgttgtttctgaaatgggcggaaatatgatcgtaaatgtaaaggattccagagtggcgattggaaaggatatggccaataagatcctggtggaatagagaaggagaaaaagacaatgacattaaaggaagttccatgcggaaaaacagttaaggtaacaaagcttagcggggaaggcccggtcaagagacggatcatggacatgggaatcacaaaaggagtagatgtttttgtgagaaaggtagctccccttggtgatccggttgaagtgaccgtaagaggatatgagttatccctgcggaaagcggatgcggaaatgattcttgtggagtaattttgcaaatgagttaggtatgactaataccggataatttaggtgctgacaggcagaaagaggtagagtatgtcaattaagattgcattagcaggtaatccgaactgcggaaagacaacgctgtttaacgcgctaaccggctccaatcagtttgtggggaactggccgggcgtaacggtagagaagaaagaaggaaagctgaaaggccataaggatgtgatcatcatggaccttcccggcatttattccctttctccctataccctggaagaagtggtggccagaaattatctgatcacagagcgtccggatgcgattttgaacatcgtggatggaaccaacattgagcgtaacttatatttgtccactcagcttatggaattgggtattcctgtgatcatggcagtcaacatgatggatattgttgagaaaaacggagacaagatacatatccagaagttgagccagaagctgggctgtgaagtggtggaaatttccgcattaaagggaaccggaatccaggaggcggcaaaaaaggccgtagctttggcgaatcagaaaagcaaagcggttccagtccataaattcgcacaggaagtggaatctgttctggattccattgaagataaactgggaaatgagatcccggaagagcagaagcgcttctttgccatcaagcttctggaaaaggataataagatccagacccagatgaagcatgtgccggatgtatcggaagagatcagccggatcgagaaggaaatggatgacgatacggaaagcatcatcaccaacgagcgttacgtatatatttcctccattattcatgaatgctttacccgcaataaaacagaaaagctgacggtatctgacaagatcgaccggattgttacaaaccgttttcttgctctgcctatctttgcggtagttatgtacatcgtgtactatgtttctgttacaaccattggtacctgggcaacagactgggccaatgacggagtattcggcgaaggcttttccttctttggcttagacattcccggcgtacctgtagtggtagaaggaatcttaactgctgttggctgtgcagactggctccaggggctgattcttgacggaatcgtggccggtgtcggcgctgttcttggttttgtgcctcagatgctggtgctgttcatcttcctggcatttttggagtcttgcggctatatggcaagagttgccttcatcatggatcgtattttccgtaaattcggtctttccggtaaatcctttattccgatgctgatcggaagcggctgtggcgtgccaggtattatggcttcccgtaccattgaaaatgaccgtgaccgtaaaatgaccatcatgacaaccacctttatcccctgcggtgcaaagcttcccatcatcgctttgatcgccggtgcattgttcggaggagcctggtgggtagctcccagttcttatttcgtaggcgtggcagctatcatctgctccggtatcatattaaagaagacaaagatgtttgcaggtgacccggctccctttgttatggaacttcctgcataccatatgccaaccgttggaaatatcttaagaagtatgtgggaaagaggctggtcctttattaagaaagcaggtacaatcattttgctttccaccatcgttgtatggtttgcttctttctttggctggatagacggacagttccagatgctggagagcgagcagcttgatcacagcatcctggcattgctggggagcagtatcagctggatctttgcaccacttggctggggtgactggaaatctgcagtagctgccctcaccggattggtagccaaggaaaacgtagtgggcaccttcggcattcttttcggatttgcggaagtggctgaggatggctctgaaatctggggaaccctggcaggaagcatgacatctgttgccgcttactccttcctggtgtttaaccttttgtgcgctccctgctttgctgctatgggcgctatcaagagagagatgaacaatactaaatggttctggtttgccgttggatatcagactcttctggcttatgtggtatccctctgtgtttaccagatcggaactctgttgacaacaggaacttttggaatctttacagtcgttgcctttgccttgatcgcaggatttatttacctgctggtaagaccgtcaaaggaagagaacacatcaaacattcatttaagcagtgtggcaggagcgaaataagctccggccacagctgggagcctgcaacttacctgcaggctcaaaatataaggaggtactttatgggaacactggttgttttagttgttgttgccggagcggtggcattggcagtaaaaagcatgatccgtgacaaaaagagcgggaaatccattcagtgcggcggagaatgcaaaaattgcggtggacattgccattaacctgggcgagagaaggaaacacccttcgggtatccctttatgcccaaaaagcgtaggcaataataaggaaaaagctgtataagtcttaaaaatacctgtaaacggaggcgcgcaagtggagaaacaaacgaacatcaatgagaaaagaaaaatgcctgacgccagaagctatcacaggacaaaaatgcagaaagagctgatcattgagaagttaaaggaaagaggatgcaggatcacaaagcagcgctgtacgctgctggatgtcatactggagcatgaatgttccagctgtaaggagatttattataaagcatcaggtgtggatgaaaccatcggcgctgcgaccgtctaccggatggtcaacatcctggaagaaatcggggccatcagccggaaaaacatgtataagatcgtttattcggatacctgtcccatggaggaggcgtgtacagtggttttagacgatgagaccacttatcagctttccgccaagaactggaaccaggtggttcaggcagggcttactgcctgcggatatttagatggtcagaaaatatcttctattatagtaaggccctgtgaatgtgagaatgctgattgcatttaatatggagttagcattgactaactaaaggaacgagtatagagagtatggatagcggaccagaattagaattatgttcaggcagcgttgattatcatgaaatcatcgaatgcattgtgagtgcattggatgccaaagacccctataccgcggggcattctcaaagggtgagcgatatggcgctggccctttctgagtttttagggcttgataaaaaggaaatagagaagatacatatagccgcccaccttcatgacattggaaaaatcgggattcctgattgcgttttaaataagccggaaaagctttccgaagaagagtgggcggccatgaaaaggcatcccggaataggagctgatattttaagcaagtcccgtcatttaaaggaactgaaggatattgtcctgtatcatcatgaacgctttgacggaaaaggatatccggaaggtcttaagggagaggagatccctttgggagcaaggattatagccatctgcgattccattgatgccatgacatcggaccggggataccggagcgcttattccatggatcactgctatgaagaaattgaaaagaatctgggagtgatgtacgatccggtgatcggggcgttggcattaaaacattgggatcaggtgacaaaaaccgtcgataattgataaattttatcaataaatggaattatgtttgactggcgaaagcatgcttgatatgatgaaactacaaaagggaaaatctggaagtacagaggaggatacgagagatgtgggatattttaaagcttaaaaaggcaggaatctttgccggaggcgtgctctttggaacagcgggagtcaagcttctttccagtaaggatgcgaaaaaggtctacactaattgcacagcagctgttttgcgggcaaaggactgtgtgatgaaaacggccaccctggttcaggaaaacgcagaggatatccttgcggaagcaaagcagatcaatgaagagcggaccgcaaaggaagctgaggctgcagaggaagcggaaactgcaggagatagcagtggcgaggattaatagagaacaaaagaaaatgggagagcggggccgaagaagagaagggccccgttttctgtagggaggatcagatgtgaaatttatcattaaacatgaaatatcaggaaggctccgggtccgcctttcccagccgcgaatgacctgccgggaagccgatactttgttgtattaccttcacagcttgaaaaatgtgaccggagtgaaagtctatgagcgcaccggagatgcggtcatctcctacgctggcaccagagcggaaattctggaagccttaaaatgttttcaatatgattctgtcaaagtgcctgcaggagtgatcgaacattccggacgtgagctgaatgccatgtatcaggagaagcttgtgggcagagtggtgatgcgcgtggcaaggaagcttttcattcccggacccttaaggatgttccatatcgggttccagtccttgaaatatattatcaggggaatcaagtcccttctaaaaagaaagcttgaagtggcggtcttagatgccgttgccatcggtgtatctgtggtgcggggagaattggaaacagcaggttctgtcatgttcctgcttgggatcggggagcttttagaggaatggacccataaaaaatccgttggagatctggccagaagcatgtctttaaatgtgggcagggtctggcttttaagcggcggacaggaagttctggtggaagccgcctccattgtacctggggatgaggtagtggtgcatatgggaaatgtcattccctttgacggagccgtggtttccggggaagccatggtgaatcaggcttccttaacaggggaagctcttccggtgaaaaaggaggaggacggatatgtgtatgccgggaccgtggtggaggaaggagaactgaccattaaggtccgggaggtttccggttccacccggtttgaaaagatcgttaccatgattgaagaatcagaaaagctgaaatcttccctggaaagcaaggccggtcatctggctgataaactggtgccttatactcttatggggacgggccttacctggctgtttactggaaacgtgacaagggcactttccgtactgatggtggacttttcctgtgcgttaaagctggccatgcccatctctgtcctctcagccatccgggaggcaggaatgtaccacattaccgttaagggaggaaaatatttggaggcagtggcagaggctgtgaccattgtctttgataaaaccggaactcttacaaaagcaaggccgacagtgaaggaagtggtgacctttggagaagagagtccggaggaaatgctccggatcgcagcctgcttagaagaacattttccccactccatggcaaaggcagtggtgacggctgccagaaacaaagggctggagcatgaggaaatgcattccaaggtggagtatatcgtggcacacggcattgcttcgtccataaacggcagaaaggtggtcattggaagccatcattttatctttgaggatgaaggctgcaaggtggatgaggcttatcaggaaaaatttgaaagcctgccagaggattgctctcacctttatcttgctgttgaccagaagctttcggcagtgatctgcattgaagatccacttcgggaggaggccgcggcagtggtaaattctcttaaaaaggcagggatatggaaaacggtcatgatgacgggagacagcgagcggaccgcagcggcggttgccgccagagtaggcgtggatgaatattattcagaggtcctccctgaggaaaaagcccgttttatagagcgggaaaaggaatcaggaaatgtggttatcatggtgggggacgggatcaatgattcgcctgccctttctgcagcggatgtggggattgccatcagtgacggtgctgagatcgccagggaaattgcggatatcaccattgcggcggacaatctttatgaaatcgttaccttgaagctgttaagcgacagcttaatgaagcggatccataaaaattaccggagcattgtgggctttaatacgggccttattcttctgggagtgggaggggtcatgcccccaaccgtatcggcgctgcttcataatacctccactctggggatcagtttaagcagcatgcagaatctgctgtcttaggaagccgggattgacattcacgtttccctgatgtatacttgcaatgaaaactgaaaggggtgctggagaaagtccggctgagataaagcagaattgcttgaaaccctgtaacctgatctggataatgccagcgtaggaagccttcaggccatgcctgttcacccgcccggatatccggacgggtttttggtttctataaacgataaaaggagagaaaagacatgaatgcaagcgtagcaatccagacattgcctgaggcaaagaatgatgaggagctgatccgcattgttgaccaggtgatcgattatatcaaaagcacaggactgaactattatgtaggaccttttgaaaccgccattgaaggggattatgatgaactgatggacattgttaaggaatgtcagcacatcgccgtcaaggcaggtgctccctctgttgccgcgtatatcaaagtcacctaccggccggaaggggaggtacttaccattgaaaagaaagtcacaaaacatcacaagtaggctctggtcctggtcagcggtcctcgggcttttgattttgtggcagctgataaccgctcttggtcttgtggacggttatctccttccctctcccataagcgttggaagggcctttataacggaatttccggttctggccttccatggggggatcacccttcttgaggcatttttagggctttttctgggagtggggaccggctttgtgatcgcagtgatcatggatcactttaccggactttatcaggccttttatcccctgatcgtcctgacccagacagttccgacggtggccattgcacctcttctggtgttgtggttcggctatggaacggctccaaaggtgatcctgatcgtgctgaccacattttttccaattacagtgggcctgcttacaggatttaaatcggtaaatcctgatgcagtaaaccttttaagatccatgggagcgggaagactgaagatattctgctatatcaagcttcctggggccatggggcagttttttgccagcctcagaatatcagtctcctacgcggtggtgggagctgtcatctctgaatggctgggaggctttggcggactgggtgtttatatgaccagggtgaaaaaatcttttgcttttgataagatgtttgcggtcatctttctcatatccgcagtcagccttcttctcatgaaaggcgtggacatgctttcaaagaaatgcatgccatgggaagagtgaaaggaaagaggaaacacccttcgggtatacctttatgcccaaataacagggcaggaaagaggaaatgatgaaaaaaacaggtttgatgatttttatggcagcaattttagcggcatcccttactgcctgtggaggaaagggtaaacaggcggtgaatgaagaaacaccgaatttgaaaaaggtgacctttgttctggattggactccaaacaccaatcataccgggctttatgtggcacaggaaaagggatactttaaagacgcaggacttgaggtggaaatcgtccagccgccggaggatggggctgaggtgctggtggcctcaggaaaggcccagtttggtatgtccttccaggactccatggctccggctctggtgggggaaaatgcccttcccatcacagcggtggcagctgttatccagcataatacctccggcattatttccagaaaaggagagggaatggaatctccgaaaggaatggaaggaaagaaatacgccacctgggatcttcccgtggaaaaagccatgatcaaggacgtggcagaggctgacggaggagacttttccaaggtgcagctggttccaagtaccgttacggatgaagtttccgcgttaaagtcaaagacagtggatgccatatggatattttatgcatgggctggcgtaaagatggaagtggaaggccttgatacaaattactttgagtttgcagatttgaatccggtgtttgattattatacgccggtggtaatagccggaaatgaattcctaaaggaagagccggagactgcaagggcctttttaaacgctttaagcaagggatatgaggacgcgcaaaaggatccggaagaggcagccggcatcttgcttaaggcagcgccggagcttgatgaaaagctggtgatggaaagccagaaatacttagcggaccggtatcaggctgatgtggatgtatggggatatattgatccggtgcggtggaaccggttttataactggctgaatgaaaacggcctttcagatcctcagcttccggaaaataccggatttacaaacgattatctgccccagtaagctgcgggtgatttgacttttgcggaatccattcgccagatgcaggaatggattcatccctgcatccggctcattgctttcagaaataaaacgttcaggagggcctcatggcacagttaaaggcggaaggcataacaaaatcctttgatagcaagactgttttaaaaggagtatccttagagcttaaggaaggggagctggtatcccttctgggagtcagcggaggggggaagaccaccctgtttcacatcattgccggtctttccctgcccgatgaggggcatgtgtatctggatggagaagagatcaccggaaagccgggacttgtcagctatatgctgcaaaaggaccttttgctgccttaccgtaccattgtggacaatgtggcccttccccttctcattaaaggtatgaagaaaaaggaagccagagaaaaggcaggagaatattttaagctgtttggcttagaggggacggaaaggcagtatccctcccagctgtccggcggcatgaggcagagggcggctcttctaagaacttacttgttttctaattccgtggctcttcttgatgagcctttttccgctcttgacatgctgacaaagcggggagtgcatgaatggtatttaaaggtgatggaagacattcacctttccactctttttatcactcacgatattgacgaagcgatccttctgtcagaccgcatatgccttctgaccggatctccgggacggatcacgaaagagatcatcatcagggaaccgaaaccaaggagaaaggattttaatatttcagaggaattctttggatataagaaggagattataaggcatttggaagggggatgaaactttgcgggcttttgaaacgaccgctcagactgtaaaaaagcaggaaagacggaaaatgcattttgaacagcgcccttgatgtgtttaacaactggtcatataatataaacagcgtggatttaatattaaaaaatcgattaaaaaaacacaggcagaaatagttaccaacaacgttatatccgctataaaaaatgaggggaaatgatttgattatcaataataacaagcaattcaatatgtttccctcacatataagtatgagaaaatatattctctattacaacattgtttttccagagagagatacatttatagatcaatatacgctcatgcctgatgcttgcggaacattgtcgcttgcatttgatggaaacgctgtaattgcggagctttggggagcctctatgacacctgttttgttaggaatggaatccaatcactatgggattctgctgcttattcagctttcgtcctgtggtttatatcaaataacgcgcctgagtcaggaagagcttgcaaacagttgaagctgtgaaacagtatgaattgtgctttgatatataaatacatggcggatttggtaaaataaagccgtcgttttaattgcctagaatatatgggatgacaggaacatttgtaaggaggaaatctatgaattgggaaccatggacaggctgttataaaataagtgatggctgtacacattgttatttctatggaccgcacgcaaaacgctacggccaaagcagtattcaaaagacagataaattcgattggcctttaaagacaaatgcaaaaggcgaatatagaataaaaggagacaaaattcttgcaacttgttttgcaactgatttcttccttcctgaggctgatgaatggcggaaagaagtttgggctatgattcgggaaagagcagatatagaatttttgattctaacaaaacgaattgaccgattccttgtgtcgcttccgttggattggggagcaggatatgacaatgtaaatatcgggtgtactgtggaaagtcaagaactggcggactatagacttccattatttttatcctatcccataaaacggcgctttatagcctgtgcgccacttttagaagccatagatttaacaccttatcttcatggagtagatcatgttacagttggtggtgaaacagggcgagaagcccgtgtatgtgattatgattggatacttaatatccgtgaccaatgcgtaaaagcaaatataacattttggtttaaaaacacaggctcattatttagacatgacggagtggtggatcagataaatccatataagcaaaccagtgtggcgaatggatttgatataaatatttcagatggtaaaaggttattttaatggaaaacactccaatgcgcagattaatttgtccggttttagaatcatactaaattagatatgatgtaacagggccaaagtcccttaaaagatggagcgtcagttcctttccagccggcctaatgccggcttttttgtatgatggaatcagattatttctgccaggggatccggaagataaaagaagttttctcaccgggcactgaagtaacctggatgttgatgttatggcggtctgcgatccgtttcgcaattgccagaccaagaccggttcccgtccggttgttttccccaatggacatataatactcctcaaacacatgaggcagatccttttcctgtatgccgatccctctgttgctgatgattgcagtgcagttattggcgtcaatggtgactgacactccaattgactctcctggcagcgaaaacttgacggcgttatccaacacggttaccagcatctgacgcaatctgccataatcccccagaaaggaaatatttcaccgtcctgtgtatttaattctatgatatgtccccattatgtgcgatgtgccttaaggtacggaccgcatcctctacgaccatcataaagtcaatttgctgtttttctatatgatagctgggattttgcaatcgggacagttccaaaaggtcattgaccatccggttcatatgaacgctttctgtcagcatctccttatagtatttctgtacctgctcctgtcctgtcacaatcccatcacagagcgcttccaaagaactgcggatcaccgcaaccggggtacgtaattcatgggagatattggaaatataagtcttgcgcaattgttccagctccgcctgctgcctgtccgcttctttaagccgtaccgaaagtatgtccatgttattggcaaggattccaagctcatcctggcgttttacaccggtctttgccgtataatcgcctttggtcatccttacggtaatttctaccatacatttcagcggatttacaatggtacgtgagaacttgagacacggtatgatcagcaccagcagagcgatgagcatactcccggccagcacccagccggcttccagaattgtggaaaacatgtctccggtgcgggcatggatgaccaccaccgctactgtcctgccatcagagaacttcactggggaagcaataatgaagtttttctccagcatccgatcggaccaccgttcactgacagaggtttctcccttcatggcctggtcaatgagtgaccgcacttctgcgggaatggaggaataggtaatattgtatttgccaaattccacgtggatcgtctgtgtggcgctgtccacgatccaaaggttgcttagggcaatgttatctatgaaatccagataaattccaagtcttaagttgttctgcttcatctgctctttaagccccgtctcaatcggataattctccggtaactcctgctcaaaatacacgcatagggaatgcgcgatggcctctgttttctgtataaagcctgaccgataattaagcactgtagttctggtataaataatcagaaaaatgcctcctaccgtactgcacatcagaacaagtgctgcggtaaaatagagaaggatctgggcggttagtttttgtttcattttatcaccggtcctgcctgatctcaaatttatagccggagccccagaccgtcttgatctgccagttgggatggctgatatcagacagcttgtaacggagccgcttaatatgggtatctatggtgcgcgggtcaccaaagtaatccacgccccacaccagatccaacagattgtttcgggtatataccctgttacggtgggtggccatcagccagagaagttcaatctccttctttgtcaggttgacagggaattcatttaccgtcaccgtaaggttgtccaaggagatctttaaattgtcatacatgaataactgcttctgctgcagatttcccgaagcctgatcaatacgccgcataatggcacgtatcctggccatcacctcgcccggtgaaaagggctttacaatataatcgtcggcaccgatatccagtcccatgatcttctcaaagtcctctccccgtgccgtgatcatgataatggggatagtggaactgctgcggatctgccggcacacttcaaaaccatccttgatcggcatcatgatgtccaaaagaaccagatcaatatcctctctttcatatatttcaagggcctgctgtccatcatgagccctgtgtactgtgtaaccctccctgacacagtactcggtcagaacggaaacaagttgccggttatcgtcacagatcagtattgttgtcattcatgtacctccctttctattaccactataatatgaatttatggcattttcatgtcttttttgacataaagttcacaaatttgaacgtaaaatgccacatgatcgccataaatttattttattataaagtcaacaataaaatcaacatatgtgatagaattttgtagaatatacacatatgtaaaaggaataacaggaggaaaaaatgaaaaaatggattaatttactgtttactgtaagtcttacaatgtttgttcttacaggctgcggagaaagcgccaataccagcaagacagagagccaggcccagtctgaggccggtgcccctgcccgaaaagaggaactgattatcggaaccgccgccgatatcaacaacctggatttacagaaacagcaggatgctaccaacaacattgtattgaagctcactcacgaaactctgattttcttcacaaatgaaggtacgattgagccgcgtctgtgcacaggctgggagtttaaagacgacacccacatcgagtttaaactatatgataacatgtgcttctccgacggctccccgctgaccgcggaggatgttaagttcacttatgatatgggccttcaaaatgggctcagcgtattaaagggacttgttgaagtcaatgttatcgactcactgaccgttgagttggttattgacagttactcaaacgagttcttacagtctcttgcctctgttcctgtgagcattcagtccaaagcagcttatgagagcggtatggacgagccctacttaatcggttccggtccgtacaaactggataagtgggaaccagatgagcaagtaaccttcgtaaggaatgagaactattgggggacaagaaaggggggtccgaccgcattaccttccgtccgatcaaggaagcttctaccagggccattgcccttcaaaacggtgaaattgatgtctgtatcgatccgtccatggacaacctgccggatctggaagctgatgaaaacgtaaccgtatttgagagacccggtacccgtctgttctatcttggcttcaacgtaacaaggcttccgtgggacaacttaaaagtaagacaggcggtggcacatgcgattgaccgggaatctatcattgatgtggttctgatggggaagggacagtctcagactactattttaaaccgtggcctgtggagcttttttgatgacatggaaggtcatccctatgatgtgaatgctgcaaaggccgcattggctgagagcggctataccccaggcggcaaaataccattacttatctccaacgagagcgattacggccaggtagctcagttgattcaggcgaacctaaaagtaatcggtatggatattgaaatccagaccgtggagccggccacactgaagaccgagtgtgtaaatggtagccaaggcctgtatttgtggagatggaacgaggacagcaaggttgatttcgtatatcgggacttatactacaccggttccggcagcaattatcatcattactccgatccgagggctgatgagctgaccgacttaattctgactgaaaaagatcaggataagcgcctggaatactccaaagagctgcagaaatacctggttgaagcagtcccgcaggttccgctgtacattaagaatttaatcattgcctacaataagaatctgcaggacacctgcctatatggcggcggaaaccacgattggagattcgcttacgtgacagaatagaagaggtttgcttatgggacgatatttattaaacagactgcttctcatgatcccggtgatcctgataacgtcgtttctgatctactccgccatgaacatgacgggaggagatccggtcctcgctctggcccctgacaatgcgtcagaggctcagatcgagatgatccgggaagaactggggcttaatgatccgtttgttattcgctattttaagtacatgggcggaatgctgaagggcgatctgggcacctcctatgtaacaaaaaaggatgttttccaggcttacatacaaaggctgccggccaccatgcagctggcctgcgcctctgttttcgtgtcagtgctgatcgcaatccctcttggcatttatactgccatacgccagaatacctggaaggataatcttgggatggtgtttgcacttttcggtgtttccatgccaaacttctggcttgggctcatgctcatgcttttgttttcactaaagctgggctggctgccatccagcggccgtagtggtccgctgtccctgattctccctgccgtgacagttggcatgggacttgcagcactgattacccggaccacacgctcttccatgctggacgtgctccgtcaggattatatgcgcactgccagggcgaaaggggcggatgagaaacgggtgatcctcagacacggtttgaaaaatgccctgatcccgattatcaccgtagtgggtatgcagctgagcaacgttttgaccggatctgtactggctgagactgtatttgcatggcctggggtcggaaggctgatttttgattctatttccaaacgtgacacgccgatggtaaccggggctattatcatgtcctgcgtcctcatgagtatcgtaaacgtactggtggacgtagtatatgcattttttgacccgcgtatcaaggcgcagtatataaaaaagaggtgatatcatggcagcagagactgtaaaaagccgttcccaggcccaggaggtctggaggcggcttaagaaaaacaaaggtgccatgatcggtcttggttttctggtgctgctggtcggggttgccattgccagcggttttatctttgattatgacacggaagtgattggaattaaccccgcattaaagcttcagccggccaatgcgcagcactggttcggcaccgacaacctgggacgtgacattttcgccagagttttgtacggagcccgctacagcctggtaattggtgttggcagcgtggccatcggtctggtggtgggtgtgatctgcggcgctttagccggatattacggcggcatgatcgatcaggtagttatgagaacaaacgatattctgtatgcagtgccaaatattatgattgcagttgttattgtgtccctgttcggaaccagtacggtgaatctgttgctggctctgtgtgtgacggttgccacggcattcacaagaatcgcccgtgcttccgttatgaccatccggggacaggaatatgtggaggcagcctatgctatggggcttcccacctggaaggttatcgcaaagcacatccttcccaactgtctttcccctatcattgttcagattaccctttccatcggaactaccatcatagccgcctcttccttaagcttcctgggtatcggcattccaagcccggcaccggagtggggagcaatgctttccgaggggcgtaactttatccgaaattccagttatatctgtgtaataccggggcttgccattatgtttacggtactggctttaaatcttttaggcgacgggctgcgggatgcgctggatccaaaactgaaaaagtaggtgatgagtatgaacgatattatattagatattaagaacctggttatcaattatgaaacagatgacggctgtgtacgggcggtaagcggccttgatctgcagcttggcaagaaaaaaaccctgggtctggtgggtgagaccggcgcgggaaagactactaccgctctttctattttaaatctggtgccgaatccgccgggggttattcgggacggtgtcattatgctggatggtgatgatgtgctgaagaagagtcccaaggagctggaaaaaatgcggggcaacgatgttgccatgatcttccaggatcctatgactgccttgaatccggttatgaccattggtgagcagatcgcagagagtattatactgcatgaaaacatctccgaagaaggagccatggagcgggcgaaagaaatgcttaagatggtcggcattgcagagagccgcgcctgtgactatccccatcagttctcgggaggtatgaggcagcgtgtggtcatcgcaattgccctggcttgtaatccgaaactgttgattgccgatgagccgactacagccctggatgtgacgatccaggcacaggtactggaactgatgaaggggctgatcagacaatacgagatgtctatgctgttaatcactcacgatcttggcgttgtggccgaaatctgtgatgaagtggcggttatctacgcaggaaaggtggtggaaaaaggcactgccgatgaaattttcaatcatacccttcatccatatacggaaggattatttaactccatgccgaacttaaaaaagcggggcgaggaactggagcccattcagggtatgatgcctgatcccatgaacttaccggaaggctgctctttcgcagagcgctgtccttatatggcagagcattgcctacaggtacagccggagttgaaaccggctggcgacacccattttgtggcatgcctggcttatgaggataaaaatttcaagctcaggaggtatgaggatgccgggaagtaaatatgtattggaaattgaaaatctgacaaaatattttaatacaccggccggacagcttcatgccgtagacggtgtcagctttaagctggagtatggaaagactttgggaattgtaggggaatccggctgcggcaagtccaccacaggacggaccctgttaaagctgaccccgccatcctccggtaagattacctttgaaggccaggacatcacctcttacggcgctgcaaagatgcgtaagctgcgtacggaaatgcagataatctttcaggatcccttttcgtctctggatcccagacagagcgtcatacagctcatcagtgagccaatgatccaacataaactggtttgcggcaaagcggccattgagaaaaatacacgggagctgatggagattgttggcctctcatcccgatacgttaattcctatcctcatgagctggatggcggaagacgccagaggatcggtattgcccgtgctctggctgtaaatcccaaactcattgtctgtgatgagcctgtatccgccctggatgtatcaattcaggcacagatactgaaccttttaaagcagcttcagagggaccgtggcctttcctacatcttcattacccatgatttgtccgtagtaaaatacttttccgatgatatcgcagtcatgtatctggggcagatggtggagaaggcaagctctgatgatttgtttgcagaaccgattcacccctacaccaaagcactgctggcagcagtcccacacccggtagtgggaaaggaccgtccgcagcgacagctgattaagggagagatcacctccccggtaaacttacccgatgagtgccggttctccaagcgctgtgacttcacctgtgacctttgtctgcagaagaaccctgagcttaaggagctgcgtccggatcactttgtggcgtgtacgctggcagatgcaatttaaccaaatcaagtagcgaagcggattgcgaatatccgtttgaccatttatgagggcttgttttaagccctctgtttttatctaaactatgtgaagaaaatatcagaaacattattgtaagtatcaagtttattttgtataataaagacagtaaccaccacgattttctgcggagattgatggatatgataaaattgacaaattttaatgttaaaaaaatgacaattggagaaatggctaagatcaaccgcatatcagaacaaacactgaggctgtatgaccgggaagggctgttttctcccctgtaccgggatgagaacaccggataccgctactacgacatccgccaaagcgcccagttagacatgatccggtacatgaaagcccttgggatgcccctaaaggagatccgtatccatatgaaaaaatgggatatggggcgggtgaagcagcttcttatagaaaaccgggatgccattgatcagaagattgtggagcttaatctgcaaaagcgggccattgaacggactcttgacagctatgaacgctatgaggcggctcctccggacggggccattgtgctggaatacataccaaagcgccggatgtacgtaaaagagacgaaaacaaatttttatgattatgaaatcgatgagtacgagcgccttctgcgcagtttaaaggaggatatggcatcccgcaacatctctccgttttactttgccaatgccgggaccattttaaagcgtgagaactttatgaaacgaaacctgtattccacccaggtgttcgtgtttgtggaccaggaatatgttgatgaagaactgataaccatcataccgtcaggttcctatctttgtatatactgtgaccgcttttccaaggaaaaggaatacgtggaccgcctgcttgcggcaatagaagaaaatcattacagggtgacaggggattacatatgcgaagtcattgtggaaatgcctcttgattataaggaaaggggcatgttcctgcgccttcaggtaccggtccgcatgtcctgatatttggtgattttgctccattgacctgataccgtctataacctttataatgaagtcatcaggagcaaaactccaaaacaagttcttataaggaaaggatgacgatgatgatgaattacgaaaagatccgggtggtacagtatggctgcggtaaaatggcaaagtatatcttaagatacttatatgaaaaaggtgctgaaatcgtaggtgccattgatgtgaaccctgatgtggtaggcatggatgtgggcgaatttgccggccttggatttaagatcggcgttcccatccgcagtgatgctgacgcggttcttgatgaatgcgatgcagatatcgccgtagtgactctgttcagcttcatggatgacgtatatcctcattttgagaaatgcgtttccagaggggtcaatgtggtgacaacctgtgaggaagccatttatccatggacaaccgcttctgccattaccaaccgcttagaccttctggcaaaagaaaacggctgtaccatcgtgggtgccggaatgcaggatatttactggatcaacatgatcggctgtgtggcaggcggcgttcaccggatcgaccgcatagaaggcgcggtcagctataatgtggaagactatggccttgcccttgcagaagctcacggtgcaggccttacccctgaggaatttgaggagaagatcgcccatccaactaccctggagccttcctatgtatggaactccaatgaagcgctgtgcagcaaaatgggctggaccatcaaatcccagacacagaaatgcgttccttattactatgataaagacttatattccgaaactcttggagctgccattcccaaaggcaactgcattggcatgagcgcggttgtgaccacggaaaccttccagggtccggtcattgagacccagtgcatcggcaaggtttatggccctgatgacggagacatgtgcgactggaagatcatcggagagcctgatacaaccttcttcgttcagaaaccggctacagtagagcatacctgtgcgaccattgtaaaccgcattccaaccatactgaacgcccctgcaggatttgtaacggttgaaaagcttgacgatgtccggtacctgtcttatcccattcatttatatctggaaggctaagaatgaagatcaatcagtaagaagataaaaatccgcagagaaaggagactctgcggattttttgtgtgacaggaaacggaatgattaaaaacctgatatccctttttttgttttgaagaacatgatattatataaaaaagctgctgttccatgcaggcgtcagatacccgccgggttcttgggcggactgtataaaacgtttgcagggcaaaagaagaaaataacaggaggtaagaatatggatggatttgaatataaaactctgttcactgatgccaaagggatgttgggaggtaaagttgaccagggtgcattccaaagggaattgaatgaattaggccgtcagggctgggaattggtaagcacggttgctgccgctcaaagctatggaagtacaaggtggatcatttcaacatttaagcgaaaaatagagtaaatctgcaaaaccataaatgaaaactaatgataatgcgtcaaattataacatatatcgcatgataggaggaaaacgctcttaatattccgcaaaaaaccatagtaataccgaatgaacgacaaataaagcataacaaaagtgacatgaacccggaagctaggtttttctttatttcccataatgctttgacaatacccgaagtgatgctataatcagagggcatgtattgagacaaggataacaaaggagaagaaaaatgaaagttcttgaaaagcatcccatggtcatgatcgtgatcggaattataggaatttccctttctgcgatttttgtcaaatattcccaggcgccttctgtggttacggccgcataccggcttttgtggacagtgggacttatgaccccggtggtattttggaaagcccaggtcagggaggagctgaagcggacggatagaaagaccatggcattgtgtgcagtaagcgggatatttctggcccttcattttactgcctggtttgagtctttaaagcagacttctgtggcaagctcaacggcaattgtctgtaccgaggtcatttgggtggctttgggatttgtggtgttcttaaaaggcaggattggaaaggcagcccttggaagcattgccgtcaccgtacttggcagcctgcttatcgccttttctgattattcggcaggaggggaccatttgtcaggggatgggcttgcactggcagcggccatattttcagctgtttatacccttatcggtcgggaagtgcgaaagggaatgtcgacaacatcctacacttatatcgtttatgccttttgtgcattggtgctctgtatttttacagcaggggcagggattcctttttttggatatgggatcagctccgcggtggttgggcttcttctggccgtattctctaccctgcttggacacagcattttcagctggtgcttaaaatatttatcccctcctttgtatcggcttccaagctttgtgagccggtagtggcagctgtatttgccgtcttcctttttgccgagtttccggccattttacaggttgcaggaggcctgatcaccattggcggtgtgtttctttactccaaagttgagaaaaatggggaatgatttttcttgagattcccttaaaatcgtgttaccctagaaaacgtggaattacttccataatatttagaaaaggatttaaggaatgatcaggaaaagaaatcatgcgggtacgatgggaaagagcgttctcctggcagttttgtttatgctggcagggacgacagttgcactggcagatgacgcttcaaaatttgttccggggaccaggatcaacggtgtccttgtgggaggaatgacggttgaagaagcgaagatacagatagaaggcttttatggcagggaatataagctctccattcaggagaaggacggcgtaactgaggttatcagcggccctgaaatcggctatcaggtggttcttacagaagggctgcagacggtactggaggaacagaatgccacggggcgggtggcaggacctgccgccgacaattcccatacccaaaagggagcggtcagctatgacgaaggaaggttaaaagaaaagctgaattcgctctcctgcataagcggagagggtattacggttacgaggaatgcccggatctctgactggcagcagggaattccctttgccatccttccggaaatgcagggaaacagcgtgaaccttgaaaaactggaagcagtggtcaaggctgcgttaaatgaggagcttacccaaataaacatagaagaatcaggctgttatgataccgtaaccgtcacctcagaggatgccggagtgattgcccagcgggatgctcttaaccgcgtaagggaaatggaaatcacttatacctttggagataaatcggaggtcttaaaaggagaggaaatctgttcctggatatcggggatgacgggagaagtgataaacgtaagagaagataagacctctgcttacataaagtctctggcagataagtatgatacagcaggaaaggaacgggcatttcgcgtcacaggtggaaaagcctatcttcttcctggttcctatggccaaaaggtggatcaggctggagaaacagctgctttgtcttctctcattcagtccgggcaaagccagaaaagggaaccaaagtatgttcagacagtagctgaacggagcaaagcctggggcgggaattttgttgaaatagatctggcagcccagcatgtttacatgtataaggatggtgttttggcatgggattccccctgtgtgacaggaaatgtttccaaagaccacacaactccggaaggtattttcaccctctcctacaaggagacagaccggatcctgcggggagcgaaacaagcggatggcacctacgaatatgaaagccatgtgaattactggatgccgtttaacggaggaatcggtcttcatgacgccaactggagaaacaggttcggcggggatatctatcagacaaagggaagccatggctgtatcaaccttccgccggataaagcaaaggccttatacggcctggtttactcagggattcctgttatatgccattattaatcaggtgaataataagaaaagcaatactaccctgttgtcaagagcaatataaatgaggcgggccgctgcaaaaataggtaagcaatcacttatttttgcagcggtcttttttgcaaaggcttttgcaggttcccagcataaagcgattatttaaatatatccggtcagtcaaccagaatgtatgtctgaaaagaaactattttaaccgaatcaaatagtgaagcagattgcaaatatccgcttgacaggagtaaacctatgacagatcaagagatgtggaaattatttatgagtaaagaacatttacaagatgtaaaatatgaggcatgggcttttggaggcgatccggatggactggctcaattggtattagatggaatcaagactggaacagcttccgcttatccgctttacgaattgaaaaatgagccgctgcctgaagccggaagttacagtgtgatccttgattcaaaggatgaggcagtctgtatgatacaaacaacaaaagtttatgttgttccgtttaaccaggtgagcaaagaacatgcctataaggaaggggaaggcgaccgttccctcagttattgggcaagagtacacgaagattttttcagtacctgtatgtcagaagccggtaaatcatttgaaaaaaatatgttggttgtgtgcgaggaatttaaagttgtattccgggaataaatgccggttgccggcaatccgtcttaattcctgaaagaatatatgaatatcgttgaaatagaaacaaaaatttaatataatattgttaatgcaccaacaggtaggaggactggctatgaataaggaagaacagatcatgatggggttcagagacgtatttaacaagatggcctggctaaataaatctaagatggaagacaggcttaaggagtataagccctctgaagtacattgcatccaatatattggaaaaaatgcagatcccaacgtgacaaaacttgcggagtccttttatatgaccaacggtgccataagcaaaatgaccaaaaaacttataaaaaaagggattatcgaaagctatcaaaagccggataacaagaaagaaatctattttaggctcactgaccaaggaaaagaagtttataatattcatgaggaattgcataaagaatttcaagatagggataaagccgtatttgaacaggtgacagaggaacaatttgactgtatgcttaagctggtggaaagatataacaggcatctggatgaagagataaagaagcgggggatcgatgtaaaccggaacaaatttgaataatggatatgatatcacaggcagcccaactctattgagaatgggctgcatttttattttttaacattttgttgacaaggaaacaaaactgagatatgataaatatgtttcctaggaaacaaaaatatgatttttgagaggagtattaaatgtttagatttagatcacacaaggaacagagcgcagaacaaaccgtagataaaaaggcattaatcttcggtcttatgtctgtgtttctttgcggaataggcttcagtatcatatcacctgttgttccatacttagtccagccttatacaagcagccccggagagcaggccatagttgttacgatgctgacctctgtttatgcagtctgcgtgttttttgcagcccccggacttggagctttgagcgacaaatatggcagacgtcctttgctcttagtatgcctcctgggttctgcaatcgggtacacgatttttggcattggaggagctctgtggattctgtttgccgggcgcataatagaaggaataacaggcgggagcataagcactatcttcgcctattttgcagacatcacaccaagagaccagcgagtcaaatattttggctgggtaagtgcgttttcaggtgcaggcgttgtcatcggcccgactgtggggggattacttgccaggttcggttattctgtaccaatgtattttggtgcagtcatcacattattaaatgttgcttttggaatcttgtatatgcctgaaagccttcataagaataacagattgaaagagatcacccttgtaagactgaatccatttacgcagcttataaatgtcctttccataaagaatttaaaaaggctgcttgtctcagcgttcttgctttggatacccaacggatctttacaggcagttttttcacaatttacggtggatactttcaattggcagcctgcggtcatcgggctcatgtattccattatgggcatacaggacatcgtttcgcaagggctcataatgccaagacttttaataaagctcagtgatgcacagatcgcaattcttggtatggtttcagagattataggctacagttttattgcagcgtcggctttggtttcattctatccccttctgattgccggtatgtttatctttggctttggtgattcgatttttggtccttcattcaatggaatggtttccaagtcagccgatcccagtgaacaaggacggatccagggaggcagccagtcgattcaggctttggcaaggatcattggtcctgtcattggagggcagatttacgtatcacttggtcatgcagcacctgcctttatgggtatggtcctgatagcggctgcaataccggttttgtataaagatacccatgtaaacgtacaaacggcctgatctgtcagcgggctctccaatatgataatataaaggagaaatccgaggggcaaagccgaagaaaatgcggtgtaattacggctatatatttctttgtaatagttgtataatacacatatgtaaaatgaacaattaaatttaaaggagaagtcaatactgctttttattttgaaacagcctttgaagggagccgtcatcctcattatggacgttttctcagacttgtgcctgaccagctggttgaactaacatggctgacgggagctgacggaaccaaaggtgctgaaacggttgttaccgtggaattaaaagaagctgagagagagacagtattacggttaaatcatgcagggttttctgatgaagaatcaagggacaagcatgaacaggcatggccgctggttctggatcaactggaggatcggctggtgaagttttattcatagctgatgtgcaggattcatatagcacgcagatagactggaatcatctgttatccatgtcattacgaaaaggagcgcaaaaaatatgggcagtaaattaacattgaatatggttgtagtcaatgcaatggaggcaatggaattttacgaaaaggtgtttgatgccaaacggggcgatgtatttcactttccggacaaaaagggtgtaaatgaggcaaatgttatcgtaggtgacgttgaattacggctcatcgatgagaatgcatcttatagctgttatccccgaagaaaggtgaaattgactccatatggcttcagttgatcgtggatgacacggaagcagttttaaaaagagctgtggagaatggtgctgttgtggggcaggaggtatccgagttcatgggtacaaaatatgcagaaatcacagaccctttcggctacacttggacaattaaccagattgttcgggagatatcctatgaagagcgctaccagttttatgtggagcaacaggagaatgcagaaaattaagcttgttttatatttctcctaattatgcatcaaagcggattgagaatttcccattgattcggacatgaggacatgaaatcgtctccgggaccacattttttgcagtcccggagacgattgtttctttgagtgttttattttgcagcgtagctttcagccgcaaaacaaatataatagcttaaaccggtctgctgtttttcgagcatttgccggtgaaactcatccgtcattaaaaatttcgattgggcagcaaaaccttgtgcatcaatgtccatatcttgccgcataaactgaatatgctttttgatggcagattgaacctcatcggcattgacactgacaccctttctaatggcatctgccatgaaattcataaactctgaggcttcatcagccttttcattcattgcttccggatcgatgacaccggtgtcaatggtataaccgtaattttcattcagatactcgttctgtggttctaatgcagcctcccattcttgtttgttcagacctgcaaacatcttttctttactcatattagctcctttctccgcacagatgattgtttcttcaagcgtatgcaacatgctgctgatcctttgccggcgcgccatcaacaaagttttttgctcacataagcaccgcaggcgggaggggccgttttgcatgacagctttgatttttttcaggggaaaatcaagttcacggtaaaacaggatttgctggagctgttcaagctccttgtcgccatagtacctgtatccattttctgcaatactttccggcataagcagcccgatcttctgataatgatataaggtctttattgttacaccagatatatctgccacttcgtgtactgtgtatgacatgcaatttcacctcccaaaagcaactataaggtctgacctgaggttggagtcaagtgctttttataagtttttttaatgctgaatattgatatattccgctctgttgtgcagctttatcacaggagtaaataactatatcaactttctgccgaaatatcgcttgcccctatcaaagaattggtacacaaaactcacaaaatcctttttcaaccagctcagttttatatcgttccaagaccggacggctttcatcaatctgctgtttttcctgtgccataatctcactgattgtttcccagaaaagtgttacctcgttaacagtatgtaaaacttcaaagacaagatacataccggacggcaatgtaccgtgatggatccagttatcccggaacttgatttcagaaacaaagcagacatcatatcggcattgtccgagaggagtgactgcggcattatcccgtgggattccatatatgataccggtatcattccacaggttgtgattgcgtatccattgtttcatgttttccatgagctgaaaattctgtgctccgccgtatggtccggtctgacgcatgtaaacaatcggttgggccgtaatattttccacattaactttcataaatattttcctttcaaatggacaggttttccctgcacttattttttcttaacaggataataaaactcggtgatgctgtcttccggtgaggagcgctcttcccggttttccgggcttttcctgtatatttcaaagggcggtttaataaattcatatccttctgattctgcccattcacgttgtctggcatggacagacgttaattctgaaaattctcctcttattacggactttacgcacagaccggctttaaaatcccttgttccggttacaaattctttaacagggacagcaaattcaatatcatattccatggggttatattccggattatggtacattgtcatgggaattcccgttatagtaaggttttcagcagcaattttttcaaagagcttactaaaaaatcccacatatccctttgaacattcttctatgcttaacactttgcggatagaaagaatgttcatggactgtacgtcggcaagttccacatcaatcgcatcaagatatgacatcacggaatttccgttttccagacatgacatatcattatggaccatttgcaatgcagcctctaaagaagcagcacgatcctgaagatcacgtttctttttactcaaagaggaataaagcatacgatccctgtctgcttcctctgtctccatgatggacttgatttcttccagtgaaaaatgctgtgattttaaccggttgatgaacagcatgttttttagctgttcaatggaataatatcgatacccgttttcaggatttacttcgcttggtatgatcaatcctatttcagcataataacgaagtgtttttgccgatacttcacatatttttgaaaattctcctattgatagcacgagctgcctcctgatataatatataaatttatgttgctttttcatatacccccctggatcaagtataagctttgccccaggggtaaagtcaactgttatttggctgttttgtatgccactgcatttgaagaaaaaacgtttttaagacaatgaaaaatattactacaagagtaataaatattaaaatatggcatggtatccttatgtggacgaaactatttacatgttaaataaaataaagtatcataaggccatcagaaaaggacaaccaaaacgttgaaaaggagaaaagcaatgagaacgtttcatgtatgtatcgttggaggcggaagcacctttacacttggattcttaaagtcatttgtcaggctgagagaggagtttcccttaaagaagctggtgctctttgacattgacggggaccgccaggagcctattggaaagtatggtgagattctctttaaggagaggtttccggagctggatttctcttataccaccgatatcagggaagcctatgaggggatggattttatattcatgcagatgcgtgccggagggctgtccatgcgcgcaaaggatgagcacattcccttaagcatggggctggtggggcaggaaacctgcggggcaggcggtatggcctatggccttcggtcctgtgtggatatgatcaaggccgtacacgatatccggacctatgcgccggaggcatggatcttaaattactccaaccctgctgctatcgttgcggaagcgctccgcagggaattcccggaggacaagaagatcttaaacatctgtgaccagccggaaaacgtggtccgctcctgcagcaggcttttaaaatgcagctgggaggatttggatccggtttacttcggactgaatcactatggctggtttactcatatgtatgacgttcatacaggagaagacctgcttccaaagatcagggaaatggttgcccagaacggcttccttccccaggatgcggagcaaagggacaaatcctggctggacacttacggaatggtaaagacgctcatggaagattttccggatttcctgcctaacacctatgaccagtattacctgtatccggaatacaaggccagccatctgaatcctgaatttacacgtgccgatgaggtcatggcaggaagagaaaggagggtattcggtgagtgtgcagaggtgatcagggaaggaaagctgggagataagttcgatgaaatttctgatgcccatgcggaaatgatgatcaaggttgcggaatccattgcccacaataaaaatgacaggcatatcatgatcattgaaaacaacggagccattgccaatatgcagaatgatgccatggtagaggtggtgtgcgagcttggagcaaatggcccccgccccatgagagtgggaaatattccacagttttatctgggacttctggtaaaccaggtatcctgtgaaaagctgatcgtagatgcgtattttgagaactcttatcagaaagctctggaggcatttacccttaacaggctgatcaatgatgcaaagaaggccagaaaagtgctggatgccttgatcgaggctaataaaggcatgtggccggagttaaaataaggggatacggcaaaaaggaattgggggagtgatatgaaatatgctcccccgggaaatcataagaaaataagatgtaacgccgcagggaaagggtgcctgcggcgggagaggatattatcatgaagaaaaacagggtcatggactttttctcggctttggggcgcagtttgctgatgccaattgcagctttggccgcatgtggaattgttctggggttgacttccgcgctcatgaaggcgcaggtacaggcggcagctccgtttttgcagcaggggcttgtctatttcattatttttactttaaataaggtatcaagtgttgtatttacattgattccggtgctgttttccatttccatttcctttggtctggcaaaagaagaaaaggaaatagcggcatttgcaggctttatcgggtattatacatttttggtggcatcgtcatgtatgatcaattccggctttatgaatttcggagccttgaagatatccaccattctgggcgtagagacattggatatgggtgctgtagcaggtatactttccggtatcataactgcctcacttcataaccggtatcataaagtcacctttccagtggccatctccttttacggaggcaagcgttttgtggccattgtggtcattatggccatggcggtcgtgggtctgtcagcacctatcatatggtcacccgtatccatggtcattgacggcatgggaggactgatatctgcaacagggctggccggagtattcggctatggattcctggagcgtctgctgatccccaccggactgcaccatgttttaaacggcattttccgcaccacctccatcggagggacttatgaaggcgtggaagggtgtctgaatattttcttacagtttgtggacaaggtagacatttcagagcttaggccgtttacggtatttttagggcagggcaagatgcccatgatgatgttcggccttccggcagcggctttggccatttataagacttctcctcctgagaagaagaacagggtaaaggcccttatgatcgcaggcgttgcagccagtattgtatccggaattacggaacctttggaattctcatttatgttcattgcacctccgctgtttttgttccatgcggttatgggaggtctgtcctttatgctcatggcagcatttaaggtggttatcggaaacacaggcggcggcctgatcgatttcctgatctggggcgtgttccagccgggatcccggtggtactgggtgatcatcacgggacccttcttctccctgatctactattacgtattcaaaagttatctgacgaaaaagcagctttccgttgatgtatctgacgaagaaccagagacagacattcaggaaagcaccatggaggacaagcagcatgcgctggcattcaggatcatagaagggcttggaggacaggacaatatctcagcggtgaacaactgtctgaccagactccgtgtggatataaaggatatgggactggtgaatgaagagcttttaaagaaaacaggagcaatgggttttgtccgctccagcgatattcacattcaggtgatttatgggccaaaggttgaagggatcgcatcaaatgtgagggaagtattaaaatattaaaaccaaaagctgtctgaccgtgcaagtcatggtcaggcagcttctttgtttaggttaaggcagagcggaggagccgcctccatctgtctggggattctgtttgatcctggcagccagctcaatgaggatctggacaatggtaaagattccaagccttggattgatgtctacatggcggtattcctcattccggtcattggtgcagagagcgatggtgctgtaggggatcagagggctgtccttttcgcaggtgagcaggaccgtgatggcgccccgggcctttgcctttcggaatacggagagataacgcctggcatctccatgggccgtgatgatgaaaaggacggcattgctgctgatctcgtgtataagcccattcaacaggcgctgccactcgatcagaatgcagggatagtcaagggtggttaaaacggtctgaaggtatttggccgccagggagcttaaattggagccgtagatatagatgggccggtcgctggtcaaaagccctgcgatctcttccagcttttcttcatccacctgctctaaattgtccttaaataaggcgagggagtggtggattaagtcgtctgcacggaaggtctggggatgaagctgctttaattccttgcgcacctggtacttgaattcattatagccctttaacccaagcttctggcagaaacggacaatggtggcgttggaagtatataagccggcgcttaaatcgtttaaattggcataaacagctgagggaagattggattcaaaatacttaaggatctcttcttccgtatccgtaagcgtaagctgatgtgctttttcaaataaaggaatcatggtttcctccctgctccgcctgttccctgccggacagcttgtagtgcagataactgcgtatgatcacgttgatcacataaaataccggaagcctggaggtgaattctgctcccctgttttcacgctggtcggtgaagaagcggaagttgactgtggccagattggcaactgcattgttggtatatggggtgatggagagaatggggacattgttcatccgggcgattttaccaaggcgaacggtggggccgaaatcgccggtggtgctgattaagatcagcagggacttcgtatgaatattgctcaaaatgtgctctcccatttttccggattcgatcttatacacattctggcgtccgatggagaacagaagcttttcaaaatagtcgctcagaatggaagtgatccctccgggagcccataagtaaatgggacagtcgctgtcaaaataccggaaggcatggctgagctggtcctcggatataagattggaggtcccttccacattggagcacaggctgtcgatcatgatccgggtggtaaaatcctgggcctttgaagacggaggctgggggttttcctttcttccttcagcccgcagggcatatttgaactccgcaaagccggaatacccaagcttcttacagaaacgcaggatggtggcggaggaataggctgtttgggaagccagtgactgtatgctcatatccagaacctcttccgtgtgttcatagacatatttcaggatgttcagctcattgctgctcaagcttttgataacagcgtcatccagatgaagtgtgaccatgggaaacctccttgcaaatctctttcgtccattttatcacgaatacatgataagtcaatgcggccggtgggaaaactatgggggaaagatgtcctgcaatcaggaatcagtttctggcaattattgacagggtggcctctttgtgctacattcaggacatagaaagggtgaaaggagatgatatctatggctgagatcatgcctcatatcaagctgtcggaggaacaggccgttccctatggactgctgccgggagatccgaaacgtctcgatcggatcgcatcctgcctcacggatgtggaggaactggcttataacagggaattccgaagtcttaagggaaaatacaggggagttcctgtcatggcagtatccacagggatcggaggagcgtccgctgccattgcagtggaggaactggcgagaatcggagtgaaggccatgatccggatcggaagctgcggagcacttcaaaaggggatccgtcttggggatttgattctggtaaatggggccgtccgtgacgatggagcctcgtcctcttatgtggactccatctatccggccgtaccggatacggagcttttgttatcctgcatgaaaagtgccggagaattaggcgcaagagttcatgtgggtattgccagaagccacgacagcttttacattgatgaggaaaaagaagtctgtgcttattgggcaggaaaaggagtgatgggctctgatatggaaaccgcggcgttatttgtggcgggcggactgcggggagtgaaaaccgcctccattttaaatgttgtggttgagcatgaggaacccatagaagacaacatcaacagctatacgggcggagagtccgccatgatgaggggagagcatttggagatcctgacggctttggaggcctttgtccggctggatcagggttgaaagaaaaacatgaatggaggaaaatgagatgaaaaatttattcaaaaccaaattgaacgcggcctgctttgtgctgattccggcctgcattggcattaactatttaggaaagctgtttgcgtctgttttaaagctgcctctttggctggattccatcggcacctgcatcggaggtattctgggcgggcctgtgatcggcggaatctgcggagctgccaacaacttgatttacggctttactaccggtgattccattactctggtctatgcattaaccagcttgggaatcggcgttgccgtaggaatcatggcaaggatcggatacatggaaaagctttcaggagccattctcaccgcttgtgtggcaggacttacggctgttgtgatctccacgcctttaaacatcatcttctggggcgggaccaccggaaacatctggggagatgctgtctttgcctggtcacaggcttccgggcttcccgttgcccttggttccttccttgacgaggttatcgtggatgtgcctgataagctgatcacccttttgatcgtgtatgcaatcataaaaggtcttccaaagaaactcacttccctttacgaactggatgatgaagtaatgagtctggattaaagcaggaaaggcagaaatatatgaaaagtatcagtctttacgtggataaagataccttcctgaccaggctccatccctttgccaagatgttttatatcctggccgccgtcagcgcacctctgatcggaggtgcgctgtggatgtatgtcctgttcctggtccttagcttatgccttttggtcagcgggaaaatcattcagaaggtttttccgttgatcgcgttttcttttaccatcattatcaccattttcttgatacacggcctttttaaccaggaaaaccagaaggttttgtttcatctgggcccccttgtcttttatcaggaaggacttctttatgcggccaggatcgggcttaatattttaaacatgcttctggcctttgctacctttgtgctgaccaccaaacctgcacaactggtggagaccatggaacaggcaggcttttctcccaggttcggatatatgatcagttctgtttttcagatcatcccccagatgatgggaaccatgaataccatcatggatgcccagagaagccgggggctggaaacagaaggcagtttgcttgtgagagccagggcatttatccccctgatctctcctgtggtcagcagctccctgatcaacaccagggaaagggccattgccctggaggtgcggggatttgattccaggaataaaaaaacatttctaagggaacacaggctaaatggcagggacaaggtgctcatgtcatttatggccctgctcattgtaagttctattgtatggagggtgcttgtatggctttgatcgaagtgaaaaatttaaaataccggtatccccatacagaaagcctggctcttgacggaattgattttgaagtggaaaagggtcagtttatcgggatagttggcgagaacaaggccggaaaaagcaccttgtgtcaggcctttgccggtctggtgcccaccatgttccggggagcttacggcggaaagctcctcattgacggagccgaggcggcaaagactcccattgccggactgtgccagaaggtggggctggtgttccagaacccctttaaccagctttccggggcaaaggatacggtttttgaggaaatcgcctttggacttcagaatctgggaatcccaagggaagagatatttaagagggtggaagaaaatttaaaacttttggatattgaggagtataaggacagaaatccctttgatttatccggcgggcagacccagcgggtggctatcgccagcatccttgccatggagcctgaagtcattgtgctggatgagcctacctcccagctggacccacagggaagcgaagaagtgttccgggtggttgaaaagctggccagaacaggcataaccattattatggtggagcagaaaatggagaagctggcttcctactgccataagattcttctccttcacaaaggaaaacaggtgtcctttgatactccggaacggattttttcaagggatgatttagaggagcttggcgtgaaaccgcctgtgtatacccaggtgtgcaaagctcttggagtatgcaggaaagaaggagaggacaggctctatccggtcactcttgagcaaatggaagatttaagggaacaatttccgccagggcttacgggcaggaattctgctgatgaaaaggaagagggacaggctggggaagtgttccggatccttgaccttgggtttcattaccagcctgatactccggtgatccggcacttagatctttgtcttgatgcaaagccaaccgccatcatcggccagaacggagcaggaaagaccactttggtcaaactgttaaaaggacttttaaagcctgatgcagggtgtattttctttgaagacgaggacatatccaaaaggaccgtagcgcagctggccggaaaggtagggtatgtgttccagaacccggatgaccagatatttaagaaccgggtgctggaggaggtcatggtggggcctttaaacttaggtatgagccgtggagaggcacaaaagcgagcggaggaagcccttgagatggtggggcttatgggggccgcggaggaaaatccctatgatctggatttatcggaacggaaaatggtagccattgcctctgtggtggccatggacaccaaagtgctgattctagatgaaccgaccattgcccaggatgcaaaaggccgtgccgttctgggaaggattgtccgcaccttaagcgaaaaggggaaatttgtgcttgccattcttcatgacatggattttgtggcggaatactttgaccgggtcattatcatggcccatggaaagatactttcagacggaccaggggaaaaggtcttttatgagaaagaaagcttatctaaggccagactggaacagccccatgccaccagactgtgtgaattcctgggttatgagggagcatttatgacggcagaagatatgaaaataacaggcaggtagttcttaggcttttggcctttgcctgcagacagaaaacgcctggcttacagaaggattccttttaacccaggtgttttttggattcacagggcatcatttcctatgaatccaaaaccgttccgttatggatgcccgctttctgcagttgcagcatgtatggctggtgaggcagccgtgctctgacggggaaatctgccttgcggaccttttctaggttttttcgggagcacagaagaccacgacggtctgaggagtggtgatggccggaatgctccgggtggtgaacatgtaaagcacaagcagaaaatggccgccgggagtgtaaaagaagttctggccgttggataggaggatcgctgtctcgctgtcattggaaatgttcagcttcagtgtctgggaagaattcattaagtcttcgtcaaaataatcaaaaacagcctcatacccgtcactgttttccgccaggatcactgccgtgaactgaggcggataaataaggggcacaggcgcctttgtatcataaatggcaatgatggaatcaccggtgttaaaggtatgctggccaaggacataggtccttggggtgacaatgaaattggtctgtcctatgctctcgctcattatggaaatgatcatggagcagctggtgtcgccggaggcagtcattaaaggatttacggaagttactataccgtagatgggagaatagcgtgccataaaaggatccttttcatcattcttaattgtatcttatgaaggcggggtgggcattatgaaatattttgcctgcataaaagtccggaattttcttaaagctccggggcggaaatccctttgcatcctgaaggccaggaaggatagaggaaatcgtaataaaaatgtcaaaaaatataccgtaaaaatttagacaaatttcgcgtttttcatgtataataaatgctgaacgaaaaggcttgtaaagaggtaggaaattaatggaaaacgtgaaaccgcgcagcagaaagaaaaagccactgggattaaaaggctgggcagcaattggaagcgggactgtagctgcagcggcgctgattgctgccttggcctatcttcagataggcagacagtatgagaaggtgtttttccccaacaccacgatcaatggaatggatgcatctaagaaatccgtagaagaagtaaaaaagtccattgcttccggaattgatggttatgtgctgtcaatcagggagaggggaggaaacacagaggagataaagggaaaggacataggccttgagtcggtttttgacggaagtcttgaaaagattctggaaggccagaaaactcatgaatggatgaagcatgtaaaaacgccccaggaattcgatatagggaccatgattcagtatgacaaggacaaatttgaatcggctgtttccggtttaacgtgtttaaaggatgagcttgtggagaagcctgagaacgcatacttgtccgattatgtatcaggacagggctacacaatagtggccgcaaaggaaggaaaccagctggatccggaaatggtgaggaaagggctgtccgaggctgttatgggcttaaagccggaggtttctctggaagagcttggggcatacgtaaagcctcagatcccggctgacgatccccagctgattgaacaggtgcaggcattgaacaaatatgccaatgttaccattacatacaagtttggagatgagaaaaaggttttaaacggtgatacgatttccaagtggatcggaatcggagaagatggcaaggtttatttaaacagttcttctgtcaccgcatatgtgaaggaactggcttcccagtatgatacgtctacgaaagccaagaacttaaaaacctcttacgggcagaccgtaaagatcacgggaggcagctatggctggaaaatcgaccaaagtgcagaggcggatgagctggcagcgctgatccgttccggagagagccaggtaagggagcctgtctacaaacaaaaggctgccagccgcgggggtaacgattacggcagtacttatgtggaggtgaacttaacggcccagcatttgtatttttataaagacggaaagcttgtagtggattctgatttcgtatccggcaatgaatcaaagggctggtccactcctgcaggtgtgttttccctctcctataagcagaaggatgccaccttaaaaggagaagattacagaactcccgtatctttctggatgccatttaacggaaacatcggctttcatgatgccacatggcgcagcagtttcggaggtgccatctataagaccggcggctctcatggctgtgtcaatctgcctcctgctgtggcaaaaaccatgtttgagaatattgcggcaggagtaccggttctctgctatcatttgcctggaacagaatccaaaacggcctctaacggaacttcaaagccaggagaaacaaagccagccacagagccgaccacggctgcaaatcctacggaaacaccgactgcggctccgtcaaccacggctccccccacgactgcagcccctcctgcaaccagggaaccggagacagagaccacaacaagcgctccatccacagagggtgagatcggacctggagtttccgggtcttcagacaagaagaaaaccgggccaggcgtaaagtagcagtgtaccggcaggaacatataggagcaaagcttttggctgctgccccggctggcaatgtaagctggggcggcagccgtttgttttttctgaaaacaaaggatgatcttgacaatggcaggatcctgatatagggtttgatatatcagcgcagtaagattaaggaggaaaataaaatgcttaataaagatacttttgtgcccatgcagtttttcaaaaaggaagcctacaccgggagcatgaaagggatgcgctaccgggtgaaaaaggaagaggaggaattttctgccgtggtatacccggaaccgtattgctatgaggcgactcctgaggagaataaaacaagaacatcctttccttttacagaagaagggcgggaagaagtggtggactggatcaataagcagtacgaggagaaccggacaacctgggagaaaaccgcaagaaaatgatgaaaagacagggcaaagacccgcttctttgctgtatttccccctttcctaaatctatgaagtatggtatgatagtgtattattggaattactgacatggaggaagagagatggaagaaaacaaagaagacgtggtttctaaaaactttattgaacaggagatagataaggatcttgcagaaggtgtttatgatcacgtgcagaccaggtttccgccggagcctaacggttatctgcatatcggacatgcaaaatcgattttacttaactatggcctggctcagaagtatggtggaaaattcaacctccgttttgacgatactaatccgacaaaagagaagacagaatttgtggaatcaatcatagaggatgtgaagtggctgggagctgattttgaggaccgccttttctttgcttccaattattttcaggaaatgtatgattgtgccatccttttaataaagaagggaaaagcatttgtctgcgatctgactgcggaagagatcagggaataccggggagattttaagactccgggaaaagaaagcccctaccggaaccgcagcgtggaagaaaacttaaagctgtttgaagagatgaaggaaggcaggtatcaggatggggaaagagtgctccgcgccaagatcgatatggcgtctcccaacatcaacatgcgtgatccggtcatttaccgggtggcccgcatgtctcatcataacaccggcgatcagtggtgcatttatcccatgtatgatttcgctcaccccattgaggatgccatcgagtgcatcacccattccatctgtactctggaatttgaggaccacaggcctctttacgactgggtggtcaaggagtgtgaatttgcaaatcctccccgccagatcgaatttgcaaagctgtatctgaccaatgtgatcactggaaaacgctatatcaagaagctggtagaggacggcattgttgacggctgggatgaccctcgtctggtatccattgcagctttaagaagaagaggctatacaccggaatccctccgcatgtttgtggacctggtaggtgtgtcaaaggccaacagctccgtggattatgctatgctggaatactgcatccgggaagatttaaagctgaaaagacccagaatgatggcgatcctggatcccgttaagctggtcattgacaattacccggaggacacgatagaatatctggatgttgcaaacaacctggaaaatcctgaattgggagaaagaaaggttccttttggaaaagagctttacattgaacgggaagactttatggaagagccgattaagaaatatttccgcctttttccaggcaatgaggtccgcctgatgaatgcttattttgtcacctgtaccggctgtgaaaaggatgctgaaggcaatgtgacggtggtacattgtacctatgatccggagacaaaaagcggttccggctttgaaggcagaaaggtgaagggaaccatccactgggtagcttcctccactgcagtacaggcggaatgccgtttgtatgaaaacatcgtggatgaagaaaagggaaagctgaatgaagacggcagcttaaacttaaatccaaattccttgacaatcttaaagaattgctatgtggagcccagcttcgcaggcacaaaggcttatgacagcttccagtttgtgagaaacggatttttctgcgttgactgcaaggacagcagggaagatcatctggtattcaaccggatcgtttctttaaagagttcttttaaaataacaaaataacttatgacaggcttaaaaggccggtcaaacgaggagaatgctgcatggccgggagaaaaagggacgtgcagcatttcttcatatctgatcaaatgctgtcctgcgggcttacctttacaccctgcgggtatccctttatgcaaaaaacatgagcagataagaggaaaggaggaaaattttgtggagcttatgatacccttaaaaaaccaaccaggaccgccctattacagccagatttacagctatatcaaagaggaaataaaaaagggaaatatcagtccggctacccgtcttccttccacaagacagctggcggaaaatttaaaggtcagccgcagcaccactcagatggcttatgaacagctgctgtcggaagggtatattgaggccataccctgtaaaggatattttgtatgcaggatcgagggcctggtgcataccggacaggaacaaagggataagattccagcctttttccccccagcctcttctgagaagaaaagggttcctgaatggaacgtggacttttcccccagaggaattgatctttgcgcttttccattcaatacctggagaaagatatcgaaaaatacccttgtagacgataacagggagatgtttatgccgggagatccccagggagagcccgctctaagggaggctatccgttcttatctccattccgcccgcggggtaaactgtcgggcggagcagatcatcgtaggagcgggaagtgaataccttttgatgctgctgtcccagatccttggatctgaacgggtgattgccatggaaaatcccacctataagcaggcttaccgggtttttgacagcttaaaataccgggtggcccccgttgccatggaccggtccggcatggatgtgaagcttttagaaaagagcagagctgacattgcctatgtgatgccttcccaccagtatccaaccggtattgtcatgccggtaaagcgtaggcaggaattacttgtctgggcctatgaaaaggaggggcggtatctcattgaggacgattatgacagtgaattccgttacaagggaaagcctatccctgcattacagggaatggacggaagaaaccgggttatttattatggaaccttttctaaatccattgctcctgccatccgtgtgagctacatggtattgcccggacctcttttaactatttacagggaacggatgaatttttatgcttccacagtgtcccgcattgaccagaacatcctttatcagtttatggcagaggggcattacgaacgccatttaaaccgtatgagagcagtctataaggcaaagcacgatgtcctggcagcggggttgaagccctttgaaagccagttcttgatcagggggagcatgcggggctccatctgcttttgacggacaagaagggaaggccggagagcctgctcataaatatggcggcagaatcaggagttaaggtttatggaatgtcaggatactttatccatgaagagcataatacctatccttctaccgttgtccttgggtttgcaagcctcacggaagaagagataaggacaggacttgggctccttagccgggcctggtcagtagatgaagaggagggattttgtgggtgaaaattgggaggatcagaaaaggaaggaaagtcttcacatcctcctttgggtcggtcttattacgttgcttttgctgctgctcagtgtggccggtactctaagaaatgaagagccttcggcagattatactgaggcagaaacggcagaagcaaaagtcatggcagagcctttacaggagacttctcttgctggaataccccttacctccgatgataaagagtttttgaaccggctgacagagctgtttgaccagggagacttagaaggagctgccagggtgttaaacggttatgagatcccctggaagggttttccctgcatgtatgacgggacagccatgaaaacagaaatatcttccggcaaaggactggtatttataaaatcttccacagttttttacggaaatttcctgtcaggaaagcctgaggggactggtacggccctccaggtccttgaactggaggaaggaaaacggtatgattactcctatgggacatgggtgagcggaaaaatgaacggagacggggagtgcggctataattattacgatggggtaactgagggcatcacaaagctgaatgctaaaagaggtgtttttaaagatgatatgatgcagggagaaattacctacaccagcaccaatgcagaaggagagtctgctgtctggcagtttttggttgcagatggcgtgatcgtaagggatgaccggtggataaaggatacggaagattccggtgctgttatttacaagctgccggcaaaggatgatgacattcatgcctatgctttaggggaaagcgccataggagagaacaggtggaaaaacctgatcgtatttccacagggttaaaaaggaggccttgacgggtgaatcaggaaatcttagaccgtctgggagtcattacagacgaggaacgggaaattataaacggacggacggaaatcgaccgcaatcgatatactgagggaaaggatctggtcattgacagcaaaaagatgctggagcatgggaagatgatctccatcaggcctcacaccaggttcgtccattttccaaggcacaagcataattacattgaagtgatctatatgtgcaaaggggaaacaatccattatattgatggggaaacagtggttttaaaaacaggggagcttctgtttttaaaccagcacgccacccaggagatccttccggcaggagaggaggatattggagtaaacttcatcatcctgccggaattttttgacactgcttttgaaatgatgggagaagaagaaaaccttttgagggattttctggtgggatgtctctgctttgatccccgttacgccagctacctccatttccaggtcgcggatgtgctgccggtgcagaatctggtggaaaacatggtatggacccttttaagcgaccagcccaataaaaggagcatcaatcagatcaccatggggcttttgttccttcagctcatgcattatacggataagatcagccatacacaggaaagctttgagcaaaagctgatttttcaggtacttacctatattgatgaaaattataaggctggggagctgactgagcttgcggcgctgcttaattacaatatttactggctgagccgggcaatcaagaggttgaccgggcggacctataaggagcttttgcagataaagcggctgaatcaggcttctttccttcttttgaataccaggctttccataactgacatttccattgcagttgggtatgataacaccagttattttcaccgtatattccggagctatttcaaaatgtctcctaaggagtacagaaattcggtttcttagaaagaggcagggggaaatgcagaggatggaaatagaaaaaaagtctctataattgcgaaagtcagtgggtttctggaaagaatgaatggtgactttgcgttttgcatgtgatataatatctttattgaattaaggagggatgggtatgacagacagtgaaaaattagagcttttattacaggccgtaactaatattaacgatgacttgcaggaggtcaaagttgacttgcaggaggtcaaagttgacttgcaagaagtcaaggccgatttgcaggaagtcaaggttgacgtagcagatttaaaaaagaaagtatccattattgaattgacacttgaaaacgaaatcagccataatattatggtaattgcggaagggcatttagacttaaaccgtaaacttgatgaagcgatacaccttaccagtgacattaaggcaaaacaggagattcaggatttatatataaaaaggcacgacaataagctgagaaccaaagagatctcttaaccaatagaaaaaacaataaatactttactgtataaaagcgtaaagccttgtggggcattacgctttttccgtatctctgcatgggtcctcaacagagagcgctgctattacacagatataaactcaaaaataaaaggaaagaaggaaacccttctattatgagaaggatttcccgttataacagtcgtgttattgtctggttttgatttcataagtcccatgaaccaaatcgatttcaaccacagtgccgtcagcaaatgcagtgcgctgccggaaagggtcattttctatgaattcgtgatacatcatttcacacatggccaccttttcgtggagagaagagacaacgctgcagcgggcagccatttcttcctctgaaagagtctcatatccgccaaaagagccgtcaatgttttcgtaagccccatcccggataaagtaaggtgcgccgccgtttaaaagggcgtagagcatgaaatcctcattctcgtatttttccatcatccatgggatgatcatacagtcatgatacaccaggttaaagagggggacggcgattccctggcgggcagctcccggttcgtgcatcataaaggaatagggagcatagtggcagaacacaaggctctttacgcaccagtccgtcacttcctcagagctgggaaggatcccctgggaaagtaagtattcaaagcaaaggctccggtaatccaggcattccttccggttgatccggtgccatgggtggtcgcattcgtcaggctcgttgcaggtgaacacatctaagtaggcacaatccagttccactccgtttttcctgatctctgtaaaattcctcttaacatagtatggagcctgggtggcacacagataggtctgcgggccccctgcccagttggcatgctccgtcagggttccgtcaggcttttgtgcggcaaaattctgatcaaaggtttttgccctgcggtaataatcccggtactggtcgtggacgccaaagaaatatccgcattcatgcatggtatccgcaagcattttcagcttttcccagcccccggcctcttcacaggcggggatatagtctggatgctggttgtcataacctggttccgcccagccatccaggtggagatacagctttttaaggcctaaatccttgtggaaatgacggatctcaccggctcttttctcaaagctgtatacatggttgtttttatccggattttccggatcaaagaagcgggagtcaggcatgaccagggttttgatccccttatggacaaaggaaacccccaccagcttgtgaacaggggccttggcagccttttcctttaaggaacagaaggtaccctgctcctttacataggttctgtaatgcttgcagatgtcattgtaatcgcagtcagacaaaaaggagtaccgcatggtcctgcggccgttcattttgcccaggcttggcagccatttgatgccggtatgtgtgtatggaccctttgccggatgctccgcataataggcggcatcccagggctgctcacagattgctaagtagccttctccgtcttttacctggccaaaccagggcatataggaaccggcggtgcacatcataccgtcaaagggaagcttttcaagagccgtttcccaggtgtttggtatgagcagtccttgctggatgttcaaaagagtataccagcggtcactttccttttcaaattccatgtatccgggccagtatatttctgagaccgggatgctgctttctgccagggggatccattcaaaatgtatgtctcctgtggcatattccagccatgcaaccgtttcaaaggccagtccaagatccaagccctccagctgaaagccatggtaatggctgatgattccttcccctactcctgttttccattgcctgtgggtaatggaagcggcatcctgaaaatagacggcctgtccgccgatcacaagacggggcctgtattttttgtcccatttccaaagcgcattcccatgctttatggcaaacaggagggagctttcttcaaagctcaaggcggtttgattgaatataatatcttgcattgtccatcctccactgaagtgatggttctaatatagcactttttcgaaaaaaaaccttacggaatcatcacggaatcttgtcaaatcatcctgtcatcaaccatctttttcttactggcatttgtgatctcgttggagtatttcttaacggaattaaaatattccaggggagacattcctgttgtttttttaaactgtttggaaaaatactgcagggaactgtaggataagaaataagcgatctccgtaaaattcatgttcccatcccgcataatttccttggatctctcgatcttcatcaaattaaaatagtcaatggccccgcagttcttttctttgtgaaacagggaatgaagagtggaacggcttatggagaattcctcgcaaatggtttttatggaaaggtgttcgcagatgtgaaactccataaactgaatgatctgttccaaatgggtggaattggcggaaaggaccatctgttcagttaaaaccgcgtggttgggtacgccttcctcttcaaaatgatttcgttttacatggatcagaaaaatctggagatataaaaggatgagctgggcagctccaaagggtggtaaaggggcaagttctaccttttccacggaaggaatatgaaggggagtggaaaaagcctgtcttgcctctgcaatgatcctggagatgagaaatcgttcctcctgatttaagaaacaggttttttcctcaaaaaacctcatgctttcgctggtgcagcggaaggagactgccaccagattgggagctttgtttcccgacgcacttaaggcgtgaaattcatttggcttgtgaaagatcacatcgcctgcttttaattggtagaaggaatggtttgcctgtacaatgatttctcccttgtccacataaagaaactcccagaagtcatgggattcccctgaaaatacaaaatccttcatgtattcaaaatagtggacggttatgatttcccggatatcaaattctatgtttaacggtgtgctgcaatatgccatttggaatacctcctttggcttttatggtagcatgaaatcatacgcctggcaagattggataatttgataacaagacaggacaatcatgcaattcaaaccctgtgaataagagtataatagaggaaaataatgattcagccaatggaggtattcatagattcgtatggatgcctctttttgtgttttttggaaagttccgttgaaatcaccgtaagtcgggagtgcttatcctaaagatttgtgcacaataactgaaaaaatgatgaatttggtaatgagtctggacaatagtataagcatatcatctcggttcattatataatgataaaaaaagaaccatgatatcatgagtgcaggagagcaaagctgggcctgctcaccggcgcgaaggcaaaatgcctgtcatgaaccgctggttcctgatattaagaaaggaagatcatatgagaaggattacagttgcccttgcgggcttgggaagcagaggcaaggatacttatgcaccggttgcaaggctgcttcctgaaaagatggagatcactgccattgcggatattgatgaggcaaaggtggaagaggtggccaaagagtatggagtgccaaaggaacggtgtttctccagtgccgaggagatgcttgaacaggaaaagctggcggatgtgatgtttatcgccacgcaggacaggcagcatgtgggccaggctcttccggctcttgaaaaggggtacgatcttttgctggaaaagcctgtttctccggatttggacgaatgcagggaacttttaaaatcagccgctgagaagggacgaaaggtagttgtctgtcatgtgctgcgctatacgcccttttacacaaaggtaaaagagcttattgattccggagtgatcggtgatgtggtcactgtcatgggaatcgaaaatgtaggctactggcatcaggcccacagctttgtcagaggaaactggagaaattcagagatcaccagtcccatgatccttcaaaagtgctgccatgatatggaccttttattgtggctgacgggaaagacctgcgattccgtgacatcctttggaagcacctatttattcaaggaggaaaaagcgccggagggtgctgcaaaacgctgcctggatggctgcaaagccaaagaaggctgcccctttgatgcagaaaaaatatatataaccaatgaaaagaccggcattgcccatggcaagtccgactggccctgcaacgtgctcaccctccatcctgcggaagaatcggttatggaagccataaagacgggcccttacggaagatgcgtataccattgcgataacaacgtggtggatcatcaggtggtgaatttaaatatgacagacggttctactatcagttttaccatgacaggctgcacagaggaaaattccaggtatgctaaattcatgggaacaaagggagagattgaggccagccttcattccaatctcattattgtaaggccctttggaaaggaaaaagaaaccatagatgtctccaaattgtccgatgacttttccggccatgccggcggtgacaaccggatggtggagcagcttcttgatatggtcagggaaggaactgaaccaagccattccatgaccacattggaaaaatccctggagagccactacatagccctggcagcagaacagtccaggatctccggaggaaagctgattcatttgaaggatattcgttaaatgaaggggtgggagaaatgaatctttcagccttgagtttatgaatcaaccggatgtgtttgtatatccgcctgattcattcgtatacaaaatatcaataaaaaggagagagcagattatgaagaaaatgagaggaaccaaggtgctggcaatgggaatggcccttgccatggcggcaatgagccttaccgcatgcaatggaggaggcggagcttccaagggaggttctgccaccttaagcttcggaatatgggatgaaaagcagcgcccggtcatggaagccatggcccaggcctatgagaaaacccatgaaaatgtaaagattgagatccagcttaccccttataagggaggcgaatactggaccaagctggaggcagctgcaacaggaggaacggcgccggatgtgttctggctcaatgtacttcatgcagaggattattatgacggaggaatccttctggacttaaatagctatttggaaaagtcagacttggatcttggaaagaacttcccggaagcccttgtaaaagcctacaattttgatggcaagcagatcgccgtaccaaaggattttgataccaatgccttatggtataacaaagatatgtttgataaggcaggggtggcttatcctactgatgactggacttatgatgatcttgtaaaagcatgcagggatttaaaggcagcaggtcttgattcgggagcttatccttttgcctgccccatcgatttccagacatggtattaccccaccgtatatgctaacggcggctggatcttaaatgccgacaaaacagaaaccggttatgcagatcccaagactcaggaaggaatccagtgctggatcgacctgattaatgagggctattccccatcagtagccgcattgtcagagaccagtgccgatgccatgtttgagggcggccagatcgctatggttttagcgggctcctatatgacccctgagtatacttcaaatgacgccatcaacaccaagatcgatctggtagaattcccgtcatttaacggagttgagccgaacatcataaacggacttggctatgcggtgtttgcaggaagtaaaaataaggacgctgcagcggattttgcattatggcttggcagcgaggaagccatgaagatccagggagagagcggagtcgttatttccgcacggaatgacgcacagaagtatttttcccagtccaacaaggatttgaacctggctgcctacaccaatcattccggtgaagcaaatccccttcctgtatgtaaatccgtggcagagatctatgatgtggaagcagaggccttaaaggcagcttattccggcgaaaagcctttagcagatgtatgcagccagcttaagactgatgcagatgcaattctggcaaaaaataagaagtaggtgtatggaatgcagggtacgacaaaaaagaaaatagcaaagcggcaatggaaagaatggggagaggggtatttgtttatagcgcccctgttgtttggaatcttcgtgttttatatttttccctttatccagaacttctggttcagctttaatgaagtgaataaattcaatgtagccaccttttatggccttaataactatctggaaatgtgtaaggataaagaattgtggaaggctcttggcaatacacttctctacgtcggggttactgtgcccttgggccttatgttgtccttgtttgtagcggccctgctcaatacaaaaatcaaagggacttctttttacagaaccgtctatttcctgccttctgttaccatgtcggccgcagtggcgatggtctggaaatggatatataatgagcagtacggccttttaaatgcggcaatgaaggctttgggttttgctccccatggctggattacagacccaaagacagctctgtttatggttatgctggttggaatatggggaaccgtaggctataacatgatcatacttttagcaggtatgcagggaatatcaaggtcatattatgaggcggcatctgttgatggagcaagcggcattcaccagttttttaagatcacggttcccatgctgtcacccaccatattttttgttatgatcacttccatcatcagcggttttcaggtgtttgacaccatttatatgatgatcggaaaaacgaatactgcttatcgaagcactcagactctggtcatgatgttctaccggaatgcctttgattacggccataagggctatgcagcagccatatccattttaatcttttctattatcatgctggtaacagtcattcagatgataggccagaaaaaatgggtcaattacgactaaaggaggtaaccgatgaagagaacgagcagtcgaaaaaagctattgatccatctgattctgatcgcaggaatcggcatcaccgtgcttccctttctttggatgctgtgtacctcatttaaaacaaaaggagaatccatggcgatcccgcctacgattcttccggaccggtttgtcacagaagcctatcataacgttctgaccgctcttccttttggaaggatctatatgaacaccgtattttctacggtcataacggttgcgggacaggtggtgatctgtaccctggcagcgtattcctttgccagaatcaaattcccgggaagggatgtactgtttttggtggtgctttccgtcctgatggtaccgggacagatctttctggttccccagtacttaattgtgcagaagatcggacttttagatacgctgtttgcgctttttctgcctaatttattcagtgccttcgggacttttatgatgcggcaatttttcttatcacttcccgatgagctggaggaagcggccatacttgacggctgcggcaggttccagatcctgacacagatcatggttcctctggttaaatcagggatcgtggctcttgtgattttcacggcaaagtttgcctggaatgactttatgtggcccttgatcgtcaataccaccacaacaaagatgaccctggctccggccttgtccactcttcagggacagcataccaatgattatcctgctcaaatggcaggcgctgttctggctgttattccaatggttgttttgttttttatcttccagaaacagttcattgaaggcgtggcccatacaggtgtaaaaggctgaattcccatatctgaaaaatttttagaatgagaagaagcttgtttgaaacagggaaaggaaagcggatgaaatctgctttccttttttttgtcatggggcaatgaaaagccttttaaaaccggaaactttccataaaagttcttcctgaagaaatttcaacggcagaaatgataaagtaataaacaaaagaaactttgcatatacttggtaatatatggtcgatataaaatatttctgtaaaggagagaaccagtatgccaagaggagtaagaaagacaccgcttgaaaagcttcaggaagaattaaaagaggtccaggaaaccatccagcaatataagaacagcttggtaactttaggagaaaaagagaaggaaattcaggataaaataaagctggaacaatttaaggaagtatcatccatattggacgagcatgagatgtcgatcatggatttaaaggaactgcttatttcatcaaaagcagagtaataaactcagactgcagagaaaagatattcaggaaagggcacagtcagattcttttaagcgtgtatctattttattgtatatattgtaaattgtgtgatttaaccggatcaagtggcgaagcggattgcgaatatccacttgacactatatgtttatataaccaattataaggagggcgctattatgccaagaggtgtacgtaaaacatcactggaaaagcttcgggaagaattaaaaaatacacaagatgccatagaacagtataaggctgctgttaagactcaggaagaaagagcaaaacagatacaagaagaaattaaattagaggaattcaaggaggtatcagccattctccaagaaaaaaatatgtcaatatcagaattaaaagatatacttatcagtaaagaatagtgtatatgccaaatgccctgattgggtgtttggcatgtttttagcttggtgcagcaattaaatcctgataaatcagatgaataaaacccggcaaaggaaaccattttgctgatcatgcaaataaggacgcagttttaattaaacagcgtccttatttttattgcggagatccattatgatataaagtagaaacaatctgtgagtatacgtttaaacctgatgtccggtggtgcgggacatggtgtaaacgggtgcccctgttaaaaaagcgggggcagtatgaaagaaaacaatgggagagtggtttacatggagaagtattatcttgctgtggacatcggcgcctccagcggccgtcatattcttgggacagtgagggaaggaaagctggtacttcaggagatttaccggtttggcaacggcatgaaacggaaggacgggcatttgtgctgggatgtggaggctttatttgccgggatcaaagagggtatgaaggagtgcaggaagcttggtaagatcccggtcagcatggggatcgatacctgggccgtggattttgttcttttggatggggaaaaccggatgcttgggaatgcaacgggataccgggataacagaacaaatggaatggatgaaaagctgtacaaagtcatttctttaaaagacctatatggaaggaccggcatccagaaacagatattcaacaccatttatcagcttatggctgtcagagaagagaatccggaatatctggagaaaggggaatccttcctcatgatcccggactatttccactatctgctgacaggagtgaaaaagcaggagtataccaatgcaactaccacgcagctggtaaatgcggaaacagggacctgggattatgaactgattcaaaagctggacctgcctgaaaggctgtttaaagagctgtccatgccgggaacaactgtaggactattggcagaggatttggaaaaggaagtgggattctcctgtcaggtggttcttcctgcgacccatgataccggttctgccgttatggcggtccctctggttccaggcggagaggatcccatgggagatatcctttacatcagctcaggaacctggtcccttatgggcacagagctttctaaggcaaactgctccatggaaagcatggagttaaatttcaccaatgagggcggttatgaccaccgcttccgatacttaaaaaacatcatgggcctttggatgattcagtccgtgaaaaaggagcttgaagaaaaaggggaggcttactcctttgcagagctttgccggctggcctctgaggaacggattccttccattgtggactgcaatgacagcgtgttcctttcgccggagagcatgatcaaagcagtgcaggagttctgccaaaggtctggaatggctgtgccaaagactgcgggacagctggcggcagtcatatacaacagtctggcagcctgctacgggaatacggtaaaggagctggaagccattacaggaaataactatccggccattcatgtggtaggaggaggttccaatgcggagtatttaaaccagctgactgcagactgcacaggccggaccgtttatgccggaccgggagaagctactgccatcggaaaccttcttgcccagatgcttgctgccggggagtttaaaagcctgaaacaggcaagggaagcagtataccggtcctttgcagtaaaagagtaccagccccgcaataggctgtcatgaatggaggagacgacatgataagaaaatcttttaaaatgtacttaaatgaaggaatggccgaagaatatgaaaagagacataatctgctctggcctgagatgaaggaaatgatcagccggcatgggggacacaattactccattttcttagatgaggagaccaatgtcctttacgggtatattgagatcgaagatgaagagaaatgggcggaatcggctgatactcccatcaaccggaaatggtgggatttcatggctgatatcatgaaaaccaacccggacaacagtcctgtttccattggtttaaagcctgtatttcatttggattaattaaatcgttaaaaggagaagagagccatgacaataaaagaaagatatgaagcagcaagggaagcatacaaagccgtcggcgtaaatacggatgaggcattggaagccttaaaaacgatccccatttccatgcactgctggcagggagatgacgtgatgggatttgatggggatggagccttatcaggggaattcaggctacaggcaattaccctggccgggcgagaaatcctcaggagctgatgagggacatggataaggcgctgagcctgatccctggaaagcacaggattaaccttcacgcaagctatgctatatttgaggagggagaatgggcggaccgggatcagctggagccgaaacacttcacaaagtgggtggagtttgcaagggaaagagggatcggcattgactttaatcccaccttgttttcccatccaaaggcggaaaatgccaccctgtccagtgaagatgatgagatacggagcttctggatcagacacgtgcaggcgtgcctccgcatttctgagtattttgcaaaggagcaggggactccctgtaccatgaacatctggattcccgacgggtttaaggatataccggcagaccgcacttccccaagggcgagattaaaggattctcttgatcagatcctttccattgactacgataggaccaaggtatatgtggctgtggaatccaaggtatttgggataggaatggaaagctgcaccgttggttcccatgagttttatatgaattacgcctccaagaatgatatcctctgcctgctggacagcggccattatcatcccacggaggtggtgtctgataagatatcttccatgctcctgttttttgacaaggtggcccttcacgtaacaaggccggtgcggtgggacagtgaccatgttgtgctgtttgacgatgaaacaaaggagatcgggaaggagatcatacggggcggggcggaccgcatccttctggcccttgacttttttgatgcaagcatcaaccgcttaagcgcctggatcgttggaatgcgcaacatgcagaaggctcttctgaatgcccttcttcttcccaatgaaacccttaaaaggttacaggaagaacgcaattttacggagcagatgatgcttcaggaggagcttaagctttatccgataggcgatgtttggaactacttttgtgagataaacggagtgcctgcaaaggaagactggtttgaagagatatgctgctatgaaaaagaagtgctgcttaaccggaaataaggagaaagataatatgaagatgttagatacggaatttgtaaaaagctttatccgcttatgtgatgacggcttccgtcagaactggcatgagaggaacggcggcaatttaagctaccgcatcaagcagtcagaggtggaatccataagagaaggctttacggatgcaaatccctggcagcccatcggcaccagcgtgaagggtctggcaggagagtattttatggtaacaggaagcggaaaatacttccgcaacgtgatcctggatccggaagccaatacctgtattattgaggtagatgaaaagggcgagaattacaggatccgctggggtcttataaacggcgggcgtcctaccagtgagcttccttcccaccttatgaaccatgaggtcaaaaaagaggccacggctggaacgcacagggtgatctaccatgcccatcctgccaatataatcgcccttacctttgtcctgcccttggaggataaagtgtttaccagggaattatgggagatggctacggaatgtccggtggttttccctgccggcgtaggtgttgtgggctggatggtgcctggcggacgtgatattgcagtggctaccagcgaattgatgaagaagtacgatgtggctgtctgggcccatcacggcctgtttgcttccggagaggattttgacttgactttcggccttatgcatactgtggaaaaatctgcggagattcttgttaaagtgctttccatccgtccggataagcttcagaccattacgtctcagaacttccgggacttagcggtggattttaaggtgaatttaccggaagaattcctgtataagaaataaactgtgatttaggaaatgcggcaacagcattgaaaaaagccactgcagagcgagcgctttccagtggcttttcccaggttccattactaaattgttttaatctatttcttcttccacaatggtagtggtttcatcggccagttccttaatcgccgctccggtagattgggctgcttctttagtggcctcaaatccgtcctttgctgcctcctttgccgcctcaaacccctcctttgctgcatctttggctgtctcaacagctgtttccgctgtttccattatagagtccgctgcctctgtggcctcttctgccagacggtctgcggctccggcagcataatccaaaccgccatctgagctgtcttcttcgtcatctaaatacgtatctgcctgttcttttgcggattcaaacatgtccttcgctgtaaaagccatagcagaagccgcttcctttgccgtatcggagacaatacttgccgcatccttaaccaggttttttgccgcactcaccgcatccttggcagcatctgccatatggtcagcggcgaccttaaattcatccttattggcatgtaaggaaacatagttgcggttcatcgtgctgtcaattttggaaatgtcgtcattcccttcatcttcaaaatcatggaaattttcttccagttctttgtggaaggatttgtattttgtaaaataagagataccggcggcaacaacgccggccacagtggccagtgccacaaatttcccaaacccattacccttttttgccatttgaaacactcctttccttattaccgcccgtgtattctggacataacggtatgcttaaaaggcgcttttttattaacgcctgtgcattttaaacataacggaatgcctgtaaggctcttcattctatgttattgtaatacgttcatagaaaaaaataaaggtatataataagaaaatttctataaactatgtaggtaaaggagaaaataccgcaaatatggtaaaaatgtaaaaaaaatataaagttagcactcaactattgacagtgctaataatgagtgatataacttagtatgtgaataaaataaaacttctttcggaaggccaaaagaaagaaataataagcagaaagctatgaggaggaattgcaatgaaattagtaccattatttgacaaagttgtgttaaaaccattggttgcagaggagacaacaaagtccggtattgttctgccgggtcaggcaaaagaaaaaccccagcaggcggaagttatcgcagcaggaccaggcggtctggtagacggcaaggaagttaccatgcaggttaaagtgggcgataaagtaatcttctccaaatattcaggaacagaaatagagaccggagaagacgatgagaaatatgtaatcgtcaagcagagtgatattttagcagtgatcgaataattttagaaggcaatactgaaatcataacagatagttttagataatacgtatttttatttttagaagaaaactggaggaatgaatcatggcaaaacagattaaatatggcgtagatgccagaaaagcacttgagtccggagttaatcagttagcagataccgttcgtgtaacattgggacctaagggaagaaacgttgtactggataaatcctttggcgcacctttgatcacaaacgatggtgttaccattgcaaaagagatcgagctggaggatgcctttgagaatatgggcgctcagcttgtaaaagaagttgctacaaagaccaatgacgtggccggtgacggtaccacaactgcaactgttctggctcaggctatgatcaatgaaggaatgaagaacctggcagcaggcgcaaacccaatcgttttaagaaagggtatgaaaaaagccacagaagcagcagtagaagctattgcaaagatgagcgagccgatcaaaggcaaggcatccatcgcaagagtagcagctatttccgcatcagatgatgaggttggcgagatggtagctgacgctatggagaaggtttccaacaacggtgttatcaccattgaagaatccaagaccatgaagacagagctggatcttgtggaaggtatgcagtttgacagaggttatatctctgcttatatgtgcaccgatatggagaagatggaagctaatttagacgatccatacattctcattacagataagaagatctcaaacattcaggagatccttcctttattagagcaggtagttcagtccggcgcaagacttctcatcatcgcagaagatgtggaaggcgaggctttaaccaccttaatcgttaataaattaagaggtaccttcaatgtcatcgctgtaaaggctccaggctacggcgacagaagaaaagagatgttacaggatatcgctgttttaacaggcggtaccgtgatttccgatgaattaggctatgagcttaagaatgcaacccttgatctcttaggacgtgcaaaatccgttaaggttcagaaggaaaataccgtgatcgtggacggctgcggcgataaggaagcaatcaccgcaagaatcggccagatcaagggccagatcgaagagaccacttctgattttgacagagaaaaattacaggaaagactagcaaaattatccggcggcgtagcagtgatccgtgtaggcgctgcaacagagaccgagatgaaagaagcaaagcttcgtatggaagacgctttatccgcagcaagagcagctgttgaggaaggcgttatcgcaggcggcggttctgcttacgttcatgcgatcaaccagatcgaagacactgtaaaggaactggaaggtgatgagaagaccggaggaaagatcatcttaaaggcactcgaagctcctttataccacatcgtagccaatgcaggtctggaaggaagcgtcatcatcaataaggtgagagagtccaaggtgggaaccggctttgacgcatacaaggaagaatacgttgacatggtggaagcaggcatcctggatcctacaaaggtcaccagaagcgcccttcaaaatgctaccagtgttgcatctaccttattgacaacagagtccgttgttgctaatattaaagaaaaagcacctgcaatgccagcaccaggcggaatggatatgatgtaacattcacgaaagcaatgagcagtgcgaagcggaagatgaaaaaaatttcgttgtgcttgcacataagaaattttttccatcttccgcttcccagggcgaacgcccgtgagcgggtaaagcctgcggctttacccgctgcactgcggatttccggtataacaaacatcttttgaatcgggacaggctgcgccgtaagaagccatgcaggtaagaggaaaggacccagatcgttatgaatgaaatgtatgcagaatggctagtgaagcgaaagtctccggcctataccatgttgataaaaattgcgatgggaatcctgtgcgtgatcgcgtttttcctctccatgtctccggttttcgggatctttggagtgctcatcctgcttgctgccgttgcggccgcttattttgtattccgcaacagtgaagtggaatttgaatacctgtatgtgaccaatactctttccattgaccggatctacggcagaagcaagagaaagaaagcctgggaaggttccatggaagagattaagatcgttgctcctaccggctccacagaagccagggatcacgaaacaaagaatatgaagttactggatttttcttcccacgcaccgggagcaaagacttatacattaataagccaggccggtgccgaaacgaccaagatcatatttgaacctaacgataagctgcttcagtgtatgaggatgacggcgccgcgtaaggttgtgaaagcagtataaaataaaaaaggaatcagatgttttattaaaacatctgattccttttttatttttacaaaagtttcttaaagaagttattttgccggatacatcggttcaaagccgtaaaatcttcgttgacaaccccttaaaaatttggtacactagtgtaattgattagagcgttaaagtttttgaaaaaaaacgttaacgcttaaataattatgaggaggacgaagatgagaagtagcaaaaagttaatcagtttcctgtgtctggctgccatgacattaagcctggccggatgtggggcttcaaagccggcggaaacgaaatcagaaacaaaggaatccgcggcagatgcagcgaaggctggcggaaatgtattgaatgtgcacatcgacgtggaagtagcttccatggatccgcagattgcggtggatggaacttcatttgaagtaatcgcagatgtgacagacggtctttatgcgttggcggaagacggaagcgctgttcctgcattggcggacaagattgaaaaaagtgaggatggattaacctacaccatcactttaaaagatgccaaatggtccaatggaacccctgttacagcaaatgactttgtatttgcatggagacgtctggtggatcctgcaactgccagtgaatatgcatttatgggcggcattgcaggcatcaaaaatgcagacgccattggcggaggcagtgtggcaccggatcaattaggggtaactgccgttgatgaaaagacattggaaatacaattagataatccggttccttattttgaatccctgatggcattcccggctttttatccggtaaatgaggaattctttaaaaaatgcggggatacctttgcaacatccccggaaacaattttaagcaacggccagtttgtaataacttcttatgaaccggcagcaaccacaattgaattagttaaaaatgaaaattactgggatgcagctgcggttaagcttgacggtcttaagtatcaggtaattaaagacagccagcaggtaatgcttgcttaccagaatggtgatctggatactgctattctttccggagagcaagtagagcaattccagggtgaccctgaatttacgaatattatggccggatatttatggtatctttctccaaacctgaaagtagccgggctggaaaacttaaatctcagaaaggcacttgccctttcttttgacaaaaaggcaattgttaataacattttaaaagacggttctattgtggcagactttgcaattcctaccggtcttgcaaccggtcctgacggcaaagatttccgtgacggaacagctacttacctttcaaccgacaaagcaaaagcattagaatactggaatgaagccaagaaagagcttggggtagaaacccttacatattccatgattgtagaagatacagaatccgcccagaatgtggcccagtttattcaggctgaggttcagacaacccttccaggcattacgatcaacttggaagttctgccgaagaaaaacagagtagagagaatgcaggaaggtgaatttgaaattgccctgacacgctggggaccggactatgcagatcctatgacatatgagaatatgtggatcaccgatgatcccaacaactatggtttctggtcaaatgcagaatacgacgcaatcattgagtccgcgaaaaaaggagaactggcacttgatccggctgccagatgggaagctctgaaaaaagcggaaggcattgttatggatgatgcagttattttccccatctaccaaaagggcaatgctgttatgatcaagagtaatgttaaaggcattgaattccattcagtagcaattaacagagtatttaaaaatacaacaaaaaactaataccataatcacagctttattgaaagacgcttataaggcggataaccgcagtacgcggcccggcctgtattcaatcaaaagttgcttgtatacggtttcatacggtcatgcaggcaactttttgaattaagggcaatgggaaaggaagttattatggtaatatttacttagaaagagaagtaatatgatatgaaaaaatatttgcttaagcgagtagttgtttcgataattaccttattagccattttaatcatattatttttaatgctggagtttatgccgggatctccgtttaatgatgaaaagttaacggcagatcagatcgccatattaaatgcaaaatatggacttgataaaccggcattccttcgttttataaattatatgaaaaatatgcttaccggggattttggagtttcctataccatatctaaaaacacaccgatttcacaattactgcagtctcgtttacccatatctgtccgcatcggaggacaggcagttttacttggaactgtcataggtataattttaggcattatagctgcgcttaaacataataccatatgggataccttaacaacggttgtttccgttttaggagtgagcctgccttcttatgtttttgcactggcgttatcttattcccttggttttaaattacggtggttccccctgctttatgacataaccgctcctttaaaatcttccgttttgccgactgtatcactatgtatgtttaccatagcaacggtagcacgatttaccagaacggaaatgctggaagtgcttggatcggattatatgcttttagcagaaagtaaaggaataagcgggtttcagttaatatttaagcatgccttaaggaatgctctgatccccattattaccgtgctggctccgttggttgtaggattgatgacaggaagtctggtagtggaaaaaatattttccataccgggaattggaagcttgctggtaacagcaatacaggccaatgattataatgttattcttgcattatcctttatttacagtgccatgtacattggaatcatgttatttgtagatattctctatggtatcattgaccccagaatacgattggcgaaggggggagcatcatgacagatttaaacgaaaataagccttttacagctcatgactttgaatttctgcataaggattccatatcaaaggtggatcaaaattattccagtcaatcctattggaaagatgtatttcagcgtttcataaaaaacaagggtgctgttatcagcctgataggcattgttttaatcatcatgctggcaatttttgcgcctcactggacagcgtatacatacgattcccagatcattgcaaaccagaaccttgcaccccgtattccagggcttgaaaaaatcggaatatttgacggttcagagaccatgaacacttctacaggcgttacaaaaatcaataaatatatatccgctgacggtgcagaaacggggctggaggatacctattattggtttggttcagatgttcttggaagggatatctttacgagaacatgggtgggaaccagaatatctttgtacattgcattggctgcggtcatgattgatatggtatttggcttaagctatggcttgatatcaggttatttcggcggagcagtggacaatgcaatgcagcgttttgcggaagttttaaacggtattcccaatctggttatcgtaactctgttaattattgtattaaaaccgggattaataaccataaccttttccttaatgattaccggatggatcggcatgaaccgtattgcaagagcgcagatgctgaagttaaaggagcaggaatttgttttggcttccaggacccttggagcctctgatctgacaattatatttaaagaaatattgccgaatatttttggacagattataacaaataccatgttctccattcccaatgctatttttacggaggcattcttagcatttatcggattaggagtgccggcgccaatggcatcacttggatcattaatcagtgattcctttaagtcctttaccacacatccttatatgattattccgccaattatcgtgttagccatattaatgctcagctttaacatgctggcagacggcatccgggatgcgttcgatccaaggatgaaagaaatgtaggaggccagaagaatggaaaaagaaaaagtactggaaattaatgatttatccatatcttttcagacttcatccggagaggtgaacgcgatacgtggagtaaagcttaatttatataaaggcgagaccattgcaatcgtcggggaaagcggaagcggaaaatcggttaccatgaaagcggttatgggcatcttaagcagcaatggaaaagtgaattccggcaccattgattttacgtatcaccgcggagacgaaaccgttcatgtggatatcttaaagctaaataaaaaacagatgcgaaaaagcatcaatggaaaaaggatggccatgatttttcaggaccccatgacctctttaaatcctaccatgaccataggtgcacagattatggaaggaatgatctggcactataagacacccaaaaaagaagcttatgaaaaggctgttgaacttttagaactggtgggaatcgtggatgccgaaaagcgtatgaagaattatccccatcagctttcaggaggaatgaggcagagggttgtcattgccattgcccttgcctgtgatcctgaattgttgatttgtgatgaaccgacaacagctcttgatgttacgattcaggctaaaatattggagctcatcaaagaaatccaaaggaaaaccggaatttcggttatttatatcacccatgatttaggtgttgtagcgaaagtagcggactacgtgtctgttatgtatgccggtaaaattgtagagcaaggaacggtaaatgatattttttatgacccaagacatccctatacatggggactgctttcggccatgccggatcttgacaccgatgatgataagctttatgccattcccggcagtccccctaacctgttgaataaagtagatggggatgcctttgcgccgaggaatatctatgctctgaatattgatacaaaagaagaaccacccatgtttcaaatatccgacacacattatgcggcaacctggctgctgcatgaaaacgcacccaaggtggaaatgcctgcagagcttagaaacaggatagacaggatgttaaaggaggctggcatgaatggaaactaaaaagcctatattaactgtaaataatttgaaacagttttttaaagtgagcagaaaatacactgttaaagcagtcaatggggtatcctttgaaatctttccaggggaaacttatggcctggtgggagagtccggcagcgggaagtcaaccataggccgttccctgatccgcctttatgagcctacagaaggagagatattatttgcaggggagaatatttccggcaagttatcgggaaaggaaatcaagcacttaagaaccggtatgcagatgatattccaggaccctatggcaagcttgaatccaaggaaaaaagtcctggatatcattgcggagggattggatatccattatccctttgcaaatgcggaagacagaaaagaggcggtctacaagatccttgcaagagtcggattgtcgaaagaacatgcaaaccgctatcctcaccagttttccggcgggcaaaggcagcggatcggcattgccagagccttgatcatgaacccaaaactgattattgcagatgaagccatcagtgcgctggatgtgtccatacaggcccaggtggtaaatcttatgaaggatatccagaaggaaaccaatacggccattctttttattgcccatgacttatccatggtaaaatatatttcagatagaatcggtgtattgcatttaggatatctggtggagacaggaaccacagaagaaatatttaataaccccattcatccttacacgaaatctttattatccgccataccccatccaaatccaattgtggagaaggagagagtttccgtaacctatgattatgctgcgagcggcattgattacgcaaaaggaaaacagcatcatattgacgggacccattatgtattggcaagtgaagaagaattgagcggttggaaataaagctgacagcggcgctgtataaggctgcaaaagaagtataaaagaaaaaggaatcggccggttttacaaaagactgtccggttccttttttcatatttctggttttactgtccatgtcagacggaaaatgatcagaaaatgtccgttgacaacccctgtaaaatttgttaaactatgtaactaacaagcgaaaagtcttattagttacattaataaaatataaagaaggagaggaaaaattaatgggtacaataattggcgaaggcattacttttgatgatgtgctgttagttccgacctattcagaagtcattcctaatcaggttgatttatcgaccaaccttacaaaaaccatcaagctcaatattccgcttatgagtgccggtatggataccgttaccgagcaccgcatggccattgccatggcaagacagggggtatcggtattatccacaagaatatgtccattgaggagcaggcggaagaggttgataaggtaaaaaggtcagaaaacggcgtcataacggacccattctatctttctccggaacatacattaaaggatgcggatgagcttatgggcaagttccgcatttccggagtgccgatcacagagggaaaaaagctggtgggcatcgttaccaaccgggatttaaaattccaagaggattttagcaggaagatcaaggagtgcatgacttctgaaaatctggtaacagcaagagaaggcattaccctcatggaggcaaagaagatccttgcaaaggcaagggtggaaaagctcccaattgttgacgatgattttaatttaaagggtcttattaccatcaaggatattgaaaagcagatcaaatacccgctgtccgcaaaggatggccagggaaggcttctttgcggagcggctgtagggatcacagccaacgtgctggaccgtgtgggcgctttggtaaaggcaaaggtggatgtagttgttttagattccgctcacggccattctgagaacgttctccgctgtgtgagaatgatcaaagagtcttatccggctctttccgtgattgcagggaatgtggcgaccggagaggctacaaaggcccttatagaagcaggcgccgacgctgtgaaggtgggaatcggaccaggatccatctgcaccacccgcgtggtggcaggtatcggcgttccacagattacagctgttatggactgttatgcagtggctaaggaatacggtgtccccatcattgccgatggaggaatcaagtattccggagatttgacaaaggcaattgctgccggcggaagcgtatgtatgatgggaagcatgtttgccggatgtgacgaaagtccgggaacctttgaactgtatcagggcagaaaatacaaggtataccggggcatgggttccatcgccgccatggaaaacggaagcaaggaccgttatttccagagcgatgccaagaagctggttccggaaggagtggaaggccgtgtggcctacaagggattggtagaagataccgtgttccagatactgggagggttgcggtccggtatggggtactgcggagcaatgaatatcaggaccctgcaggaaacaggaagattcattaaaataaccgcggcctcccttaaggaaagccatcctcatgacattcatattacaaaggaagcaccaaactacagcattgatgaataaacatatcagccgtttcaaacacgggatagtgaattgaataaccataaagtaaaaacaggtggagatcataaaagattctccacctgtttgattaccagggcaatggattccgttaaacttaagtcttcacagcccaccacataatgattgcacctgtttacaggtatcaggatcttataggcgctgcttttgccgatggcctctgccatagccggggtgatctctcctaaaagagagtcggcaatgacgatcccaatggggccgatgatgatatccgcatcccggcttgccacaatgacaggattttccccggtcgctcctgcgtcagctccggcctttaacatggcggaggtggcgatggaattggttccgatggcaatgagcggaagcttgggaaaggattttttcagctgggcaatgacggactgtcccattttgccgccctgcccgtcaataattacgattttcatggcatcctccttgccctttattgtagtatagggaaggaaagaaatcaagtattctgctatttttccctgtggggaagccgcccgcggaagaacctctttttcagttcggaaatgtggaagggaattaagggataaatatagctttttcctgcaatggttttgttaaatacaacggccaatatggaaagggctacacctcccacaaatccccagaagttaaataatgcggtggtgatcagcatgatcaatcgcatgaatttaaaggcatatcccagttcaaagcttgactgggaatagtttgctatggttacaaaggccatgtaaagcatggtttcactgttaaaccagccggattttacggaatattcacccagtacaataccggcgatcacactgaggggagtagtcagcatgcttggagtgttgactgcggcaagcctgagaccgtcaatggcaaattccaggatcaaaagctggaaaagcaggggaacctgaggttcttccgacaagcggataaatcgcagccaggaagggatcacttccgggttttgcatgaaaaacagccatgtaggcgttaaatacagggtcagaatggaaatgaccaggcgggacagccgtaagtaggttcctgtgacagggggaaataataatcgtcggcctcttcaatgatatcaaagacagaagaaggcagaatcatggcagagggagagttgtccaccaggataatgatgttcccttccagaagggaagctgcagcggtatccggcctttcggaatatttgaatttggggaaggggttgtaccatttatggggataaatgcactccgcaagactttcctggttcatggtcagggcatctactttaagcttgttgatccgatccttgatcatggtaagaagtttttcgtcatgccgtcccttgaaatagcagatggcgatatccgtatgagagctttctcctgcattcatgacttctatggtaagctttggatcacggatcctgcggcggatgagagctgtattaaaaaccagggtttccacaaatccatcccttgatcctctgaggaccttatccttttccggctctgaaacgcctcgggagggatagcttcggcagtcaactgtcagacatttgtcatagccattaatgagcaggcaggatattccggtcaaaagctgtttgatcatggcttcgtcatcttttacaaggcccacctgaccataaggaagataccttttggaaaattcgtgggcatccggcggcatatcattcgctttaatggatgaaaaactgtccaggatcttctgccacacatcactctgagtaaatccttcaatgaagtaaagacaggcttcctgctccccgatgtaaaaggtccggtagacgatatcaaagtttccggctacatccagctttgtgtttaaatggttcatgttattggaaaggctgttggaaaattccatggcgattatctccttgcaaatataatggcgaaaagtggggtaataaagaaacactttgcaggcatacgatcacaccctaaatgatgggcggcaataaagaaagtatgcgcatttttcatgaaattatgttttataaattctgtacgtataacaaagacttttgccatagtcttgtatggaaaagatatgacaatgatcctttgatttaaaaagatttttagtaaaatgtactaaaaacgttgactttttaagcaagggatggtatcatcgtccatgtgagaagcacaaaggggtttcttgtgtgcgtgatttcggcatgggatgccagatagcagaaactgaataatgtgacggtttcagatcgtgactggggattgccttctgtgggggaagggcaatcctctattaatttaaaaaaattgatacaagagaaggatttacatataataacaagaagtcccttccagggatacctttatgcccggaaaaacgggcgataataaggaaaagaggaggagttttatgtggaaaaaactgaggagagataagcgcttccgcaatgtaatgacaactctggcagttgtggtctccgcacttttacagacttttgtaatccaggcgtttattaagccggccggccttttgtccggaggatttactggaattgcgattttggttgaccgggtgacgtctttgtatggatttaatatttccacatccctgggtatggtcgctttaaacattcctgttgcatgggcttgcagcagaaatatcagcaaacggtttacttttttttccctgatgcaggtatttcttgccagcgcatttttaaggatatttaatttttcacccatatttgaagacagactcttaaatgttatttatggaggcgttctctatggatttggaatcgtcttggcacttcggggaaatgcgtccagcggaggaacggattttatcgccctgtatgtatccaacaagacaggaaattctatctggtccgaggttttcgtaggaaatgtgctgctgctttctatcttcggagcgatttttggatgggattacgcaggatattccattttgttccagtttgtaggaacaaaggtcatttccacctttcatcacaggtatgagagagtcactcttcagatcaccacggtgcagggaccaaagcttgccaataaatatgtagaaacctttcagcacggcatttcctgcgtggatgctgtgggcggctacagcaagaagaagatgtaccttcttcatacagtggtgtcttcctatgaggtggctgatattgtggccctgcttcatgaggtggatgagcatgtgatcgtaaacatgtttaggacccagcagttttacggaagcttttacagggcgcccatggaatgagtctggtctttccttaaaacaaaagcgagacttttaccgcttaaagagaacgctgcagtaaaagtctcgcatgatatagttttatgactgttatttcttaaaaacagctggaaacggttatcccttttctgcccgtcttttcaggcataaaggtattccaggaggggtttttcgctttagtttgccgaaccagttaaaatatgcgatgaacagcagcgaagtggcagtccaggtcaatgggtagctgaaaatcacggtttcaatggtggggcgtaagggaactgctacgcagatccagaccacgcggagtgcgcagacgcccaggctggtgagtatcatggggatccagcaatcccccactccccttaaggaaccggagtaaatctcgatgcacacgtaggtgaaaaaggtgggggcaaggtagcggagtatttgcgtccctttctggatcacggcttcatcggtagtaaacagcagataaacgtaattaccaaaggtataaaggagaatgctgagtacaacagcggaagcaaagctcataatcatgcagacccggatccctttgtagatccggtccttttttcctgcgccgtagttttgtcccacaaatgtggtgatggaaatgccgaaggcgctgatgatcatccaaaagacgctgtcgatttttccataggctgtccaggctgcaatggtgtcggttcccagagagttgacgctggactggatgatgatgttggaagcggagtacataacggactgaagcccggcaggaaacccgatccttacgatgcgccacagcatggccttatggatccttatggcctttggtgtcaaatggtaggcttcccttgtcctcattaacaccaggaccactaaaacggcgctgaggagctgggaaatgatggtggcaagagcggctcccataacacccatgtgccagtaaaccacgaatataatatccagaataatattggtaaagcagcttgcgatgaggaaataaagagggcgcctggagtccccgatagctcttaagattcctgctcccatattatagacaagatttgggatcactcccacaaaataaatcctcatgtaaaggaccgcatagtataagatctcgtcaggcgttcccatggccattaacgcatagggagctgccagaatgcccaccaccatgaggatggcgccgcataggatggaaaaggctattgcggtgtgaactgcccggctcacccgtttttcctgcctggctccgtaaaactgggaaatgatgacccctgcgccggaagaaagccctatgaagaacccgatcaaaagattgataaggggtcccgtagggcctcccacggctgcaagcgcttcctttcccacaaaccggcccacaatgactgcgtcggcggtattataaagctgctgaaaaaaggttccaaataaaatgggaaagaaaaacagaagaagctgtttccaaatcactccctctgtaatctgattctgcttaggtgtgtctgtcgtgaccgtattctggttcatatcatttcctctcttatgtccatgctttccggacatagaggtatacccgtagggtgtttcctcgttcatgtaattatgtattcttttcttccattatactgtctcaaatggaaaaatacaatccccggccttattcggttatctgtgcctttgcaatggcctggtctacggcctttagaagcacgcccgaagtatagcgggtttctgttgaataggaaatgttctttgtggactggtttttaacaatctgctgggacaggttatccatggccggctgtatcaaaggatacatggtggtaacggcctcgcttaagggaaccagggtaacggaagtgatttttttggagtctactaaaacctctacattgatatcctggctgttcagggtgatgacagaggagtatactcccggaacatagcgcacaggatcgccggaagtgggcataatatccttcttcgggcggaacatgactaaaaacaaagtgatgagtaggattccaagaccaacgaagattgcggtgtagatgatttctttcattcgtaaaacaacaatttttgtttttgagctcataaaaaaagccctccgtatagttttgttataatgtatgaatgagccaggaggtttcatgccaaagatttcattgttggcaaaggaaatctgtgttaagatgataaacaaacatgcgttttgcttaacccagagagataaatgggaaacaccctgcgggcatacctttattcccagaaaacatgggcataaaaagaggaaacaccctgcgggcatacctttatgcccagaaaacatgggcataaaaagaggaaaggagacgaacaagccatgtcccttcaactgatattaggcggatccggttccggaaaaacctatcacctttatacggaattaatacgacagtccttagaacagccggatacccggtatattgccattgtgccggaacagtttaccatgcagacccagaaggagatcgtttctctccatccaaatcacggggtcatgaatattgatatcgtaagctttaagcgtcttgcttaccgggtttttgaggagctggccatttcaaatcctcaggttcttgatgatatgggaaaatccatggtgctgcgaaaggtggctgccaataaaaaaaaggacttagtcctttatagagaacatttgtcaaaatcaggctttatttcccagctaaagtccatgctgtcagagctgtaccagtacggtgtatcgccggaaatgttaaatgaacggatatcggatactgtaagccccatgctccgtcaaaagctttccgatatttccgtcatttatcagggctttaaggattacatcagggataaatacattaccacggaagaaattttagatgtgctgtgcagggtcctgccacggtcagagctgattaagaacagtgtgatcacccttgacgggtatacgggctttactcctgtccagtaccggattttagagctgtttctccgctacagcaaacgtgtcatagttaccgtgactatagacccttcggaaaacttaagcagaagatccggagtacaggagttgttttacatgagccggcagatgatatggaaattaaatgagctggcaaaagagacaggagcgggaaaggagaaggaccttcttcttaagaaccatccggctgtccgctatctgggcgaggccaaagaggagaacaaggaaggaggcggcaaagtaaatgccctggattttctggagcagaacttataccgctacaaaggaaaggcctgtcatgaggcttcctcctccatacgtcttattaaagctttaaatcctatggaggagatctcgtttgtgatccgctccatggaggaagagatcaggaatcagggacttcgttaccgggatatggcggttattaccggggatattggaggctattccaatgaaatcattcaccagttccagttaaataaaattccttttttcctggatgataaaaagagcattttgaaaaatcctatggtggagctgatccgcgcagccatagagatcattcaaaagaatttttcctatgaatccgttttccggtatttgagaaccggccttattgtggggaaagaggaggagaaaactgaccggctggaaaattatgtaattgccatggggatccggggatttaaacggtgggattcccagtgggaaggctggtaccggggaggaaaggaactgaatctggaagaattaaacggattcagggaagagatcatggctcccttaaggcgcttaaaagaggcctttggggaagctgattccacggttgcctccatgacccgggcaatgacggttcttcttttggagacagggatcgaggaaaagatgctggcttatgaggaaagattccgggagatgggtgaattcacccttgccatggaatacagccaggtttacgggctggtcatggatttatttgaccggctggcagggctattaggagaagaacatgtaagcaaaagggagtatggggagatcctggatgcgggattttcggaaatccaggtaggacttattcctgctaccattgaccgggtggtggtaggggacatcaccagaaccaggctggatcacattaaggtgttgtttttcgtgggggtcaatgacggaattgttccggtgaaaaaggaaaagagcagcttattcacggaccgggagcgggagttcctgggagatcaccagatggagctggctcccactgccagagaggaaggcttccggcagagattttacctttaccttgccttgacaaagccggaaaaaaggctggttttatcctatgcggccatgggcggcagcggaaaaagcctgcgcccctccaccttgatcggtgagctgaaacgcctgtttcccggactcttggaagccccgcctttaaaaatggcggcgcccctgtccatgagggaggcaaagaaccagctggcagacgggctgcgggattacggaaagaacggagaagacaggagattactggagcttttgaaggcgtttcttttatccgatgatcaaagggaagaaggaaagaggctgacagaggccgctttccatgcctatgagcagaaaggcatcggaaaaatagctgccagggccctctatggctccgtcataagcggaagcgtcacaaggatggagcagtatgcctcctgcgcctacgcccatttcttaagctacgggctggaactgatggagcggcaggagtatgaactggctgccatggatatcggaaatctgtttcacgattccattgatttgtggtttcagcggatgaaggaggaaggaagagattttaagacccttacagaggaagaacggaaaagtctggtccatgaatgcgtgatcaaggtgacggaagaatacggcaataccattttaaaaagctccgccagaaacgcatatctggcaggcaaggtggaacggatcacagaccgtacggtgtgggccctttcggaacagcttaaaaagggtgattttgtccctgtgggatttgaagtatccttttctgccgccgaccagctaaaagctatgagaatccccctgtcaaaggaagaagccatccatttaaggggcaggatcgaccgaatggacttatgcgaggatgaagaggcagtctatgtaaagattattgattataagtccggaagcacggcgtttgacttaacggccctgtattacggccttcagcttcagctggtggtctacatggatgcggccctggagatggaggagaggagaaagccggacaagtctgtggttcctgccggaatcttctattacaatatcaacgaccctgtcattgaaagagaagggaaaatgaccgatgaggagataggcggcaggatattgaagcagcttcgcatgaatggtctggttaacagcgatttaagcgcggtctctcatctggatcacgagattgaaacagaatccgatgtgatccccgtttccatgaaaaacgggatcatacaggaggctaagtcatcggttgcaggggaaaagcgcttttcctcattaagacagttcgtgcgggagaagttaaagacggagggaagagagattcttgacggagtgatccacgtaaacccctataagcagggaaaccgcagcgcctgcgattactgtccctaccatgcggtctgcggattcgatttaaagacggccggttatggcttccggaagtttaaagccttaaaatccgaggaaatatggcctgccattgaaggggtagaggaagaaggtgaataaaatggcgattagctggactgaggaacaaaaggctgtcattgaaagcagaaacagaaatctcctggtatcggcggcagcaggaagcggcaagaccgccgtattggtggaaaggatcatccgcatgatcacggaaggcgaagcgcctttaaagatcgaccagcttctggtcatgacctttaccaaggcggctgccgacgaaatgcgggaacgtgtgctgaaggctgtggatgaaaagcttatggagaacccggacagcgaccatttgcagatgcaggcggccatgatccctatgctcagatcaccaccattgacagcttctgcctgggacttattaaggaccattacaataagctggacattgatccggccttccgggtgggagatgagggagagctcatcctgttacgggccgatgtgatgaaggaaatgctggaagagcattatgaaaaggctgatcccttatttgaaaagtttgtggaaacctatgcaacgggaaaatctgataaggggatcgaggattacatcatgcaggtgtataccttttcccagagcaatccctggccggcccagtggcttgaccggtgcaggaaggagctggaaacctgtgacatggggcagatcatggatacaggctggatgaaatttctgatgaaggatgtgaaaatgcagctttcggaattaaaattccaggtggaaaaggccatggaggtgtgcgaagaggaaaatgggccggaagcttatctgcccatgctggcaaatgacttgcatatgctggaacgcctcaatatggcagaggattacgaggctttcaatgagcagctgaaaaaggcctcctttgaccgtctggcctccataagaagcaaagacattgatgcggaaaaaaaggcatttgtgacggggatccgggaccgggtgaaaaaggcggttggaaagcttcttgacttatactgctttgaatcgccggaagaagtcctttccgatatcagagggaccagagacgcggtgactgcccttctttccctggcaggagaatacgccgaaagataccgggataagaagcgggagaaaaacctggtggattttaatgacttggaacactatgctttggaaatactgttgacaaaggaagatgggaaagatcttccaaccgaggtggccgatgagcttagcaggcagtttgaggagattctggtggatgagtaccaggacagcaacgatgtgcaggaagctttaatcagcagcatttcaagggaacggttcgggaccccaatgtgttcatggtaggggatgtgaagcagagcatctaccagttccgtctggcaaggccccagctgtttttagaaaagtatgattcctattccaaagaggaaggaaagtaccagaaaattgagctgcatcagaatttcagaagcagagatgaggtccttaaaggcattaatgaggtgttttaccagatcatgacaagaaatctgggagacatacagtatacaaaggatgcagcccttcatccgggagcagagtttcttaaggcagacgggcgtattggagagaaatcggaacttcttttgatccatgggtcagcaaatctgttaaagcagcttgacgatgacggggctgattataccagccgtgagatggaggcaaagaccattgcctggaagatcaaaaagcttacggaccctgtaaacgggcttttgatctgggataaaaaccagggtgaaaagggcggctaccgcattgcggaatacggggacatggtgatcctgctccggtctttaagcggctgggcagaggattttgtcagcgttttgatgaatgagggaattcctgcttatgcggaacggaaaacaggatattttaccgcctctgaggtggaaaccgttctttccatgctgaacatcattgacaatcccatgcaggacatccctttggcggcagtattaaagtctcccatgggcagggtgactgatgaggaaatggcccatttgatggctgtctggaaaaagacggctaaaaaaggccaggacaggggattatatggagcatggcagcattacagaaaggaatatggagatggccatgatccggattatccggagctttttgaaaagctggaagtcttttccaggctgcttactgagtacagggaaaaatcagcctatctctccattcatgaactgctttatgatctgtatgaaggaaccgggtattatgattacatttcagccatgccggcaggagaggtccggagggccaatctttccatgctggtggaaaaggcgtcggcttatgaaaagaccagctacaccgggctgtttcatttcatccgctacattgaaaacctgaaaaaatacgatacggatttcggagaggcttccctggcaggggaggagaatacggtccgggtcatgagcattcacaagagcaaaggactggagttccctgtggtgtttctggctggtatgggaaaaaaattcaataagcaggatgcttatgggaaaatcctcattgatccggatcttggaatcggcaccgaccacctggacttagaacgccgagtcaaagcgcctaccttaaagaagcatgccctgcggagaaaaatggagcttggcgccatgggggaagagctccgggtgctttacgtagccatgacaagggcaaaggaaaagctggtgatgaccggacttgaccggtatctggacaaaaagctggaacgttttgccgagatattaagggtaaaggggcagatcccctttaccatcctctgctccgcagattcttatctggactggatgctcatgagtctgtcgggaaaatattccctttcccagatccaggagccggaaggagcggacacaggaaacctgatcgtaaaggaattgactgtgcctgatctggtgggaggggagatggaaaggcaggctgaaaagaagctgacaaaggctgcgctcctttcccttgatacgggaaggatttatgaccgggagtttgaagccgatttaagggctgcttttgaatattattatccctttgaggccgatatcagactccatacaaagctgactgtgtctgaactgaaaaaacagggacagtttgtggatgaagaggaaagcgaatttattcctacgattcctgccttcttaaaggaggaagtcccttccagggatcccttgacgcccgatacctccgataatgcggggggcgctgaagcggggcgggccctgcctggaaaaacggacggaaaagaggaacgccctggagggggagctttccggggaactgcctatcacagggccttggagcttctggattttggaaaggtgagaaccagagaagagcttcggaatgctctggacggatttaagaaggatcagaggatggatgaggaaagcctttcccttttatcggaagatgttcttatgtcctttttgacctctccccttggaaagcggcttgcggctgcccagtgggaaggtcggttaaaaaaggaacggcagtttgttgtaggcattcctgccagggaaatggaggcaggggattctgacgaacggatcctcatccagggtatcatggatgcatatatggaggaggaagaaggtctggttctggtggattataagacggatcacatcaggccgggagaagaaaaggtgttaattgaacggtatcagacccagatggattactatcagcgggcgctggaacagatgacgggaaaacgggtcagggaaaaaattatatattccatggctttagaaaaggaaataaccctgggctgaacgcgtttatggattgataataaatgacaatatgttaaaataatagaagatgtatataagtacaaggagaagaacaggtatgataccagatcatgaagtgagacttacccaaatgacaaaaactgccggctgcgccgccaagatcggccctggaactcttgcaggagttttagagaacctgccgaaattccaggatcctaatctgatggtggggatcgaaacctctgatgatggggccatctataaggtaaatgaggaaaccgcattgatccagacgcttgatttcttcactcctgtggtggatgatccttatacctttggccagatagctgccgccaatgcgctgagcgatatttatgccatgggaggggaacccaaagtggctcttaatattgtagcatggcccaactgtgtcaatccggcccttctgggaaagatcctggaaggaggggcctccaaggtccttgaggcgggagcggtgctggccggaggtcattccattcaggatgatgaaccaaagtacgggctgagtgtgaccgggtttgttcatccggacaaggtttttaaaaactgcgaagccaggccgggagatgttcttatcctgacaaagcctttgggtaccgggatcgtcaatacggcagccaaggcagatatggcctcaaaagaggcgagggaggaagtgatccgtgttatgacctccttaaacaagaaggcaaaacaggtggcagaacattatgaggtacacagctgcaccgatatcaccggttttggcctggcaggccatgcggtggagatggctgacggcagcggggtcactatagaaatattcgttaaggatctaccgatccagaaggaggctccaagccttgcgcagatgggactgatcccggaaggggcttaccggaaccgttcctttacggaggaaaaggtggatttcggtgacgcagaagagtatatctgtgatattttctgtgatccccagacttccggagggcttttgatcagtgtctctcctgaagacggagaaaagatcttaaaggatctggagaaggcacagatggacacagcctacggcatcatcgggcgggtcgtggaaaaagaagaaaaatcagtaaagttgaggtaagggaaatgatctatctggataatgcggcaaccaccttccggaagccggaggaagtgagacaggctgtggctgacgccatggtttctcttggaaactccggcaggggggcccatggggcctctctggatgcatcccgcctgatttttgacacccgcaggctcttggcggagcttttccatggaggagatccttcccgggtggcttttacagccaattctacggccagcttaaatctggcaattcagggactgtttgaaccgggagatcatgtgatcaccaccatgatggagcacaattccgtgctgcgcccattataccgcatggaggaacagggtgtggagcttaccatcctgcctgcagatgaaaagggcagggttggttatgaggattatgagaaagccgtacggagaaatacaaaggcagtggtctgtacccatgcctccaacttaacgggaaatttaaacgacttagaaatcatcggcaatatgtgcagacggcatgggctccttctgatcgtggatgcttcccagactgccggagtatttaaaattgatatggagaacatgggaattgatgttttgtgctttaccgggcataaggggcttttaggcccccagggaacgggagggatctgtgtccgggagggaatttccatacgtcctctccttgtgggaggcagcggaatcaaaagctatttaaagactcagccggaggaaatgccggaagctctggaagcgggaaccttaaacggccatgggatcgcaggacttcatgcagctctcctgtatcttgagaaaacaggaatcgaaaccatccgggaaagggagcttatgcttatgagacggttttatgaaggggtaaaggatattcctggagtccgggtatatggggacttttcggaaaaagcacttctttgccgcgctccggtggttgctcttaatataggagattacgattccggggaagtagctgacgagctggcttgttcctatgatatctataccagggcgggagcccattgtgcgccgctcatgcaccaggctcttggcacggtggagcagggggcagtgcgtttttccatgtcccattataataaggaagaagagatcgacgaagccattcgtgcagtgagggagctgagcctatgaatttgaaacaactggaggcatttgtatgcgtagcggaagaaaaaagcttttcggctgcagccaagaagctttatttaactcagcccacggtaagtgcccatatcagttctctggaaagggaactggacgtccgtctgtttgtccgcaccacaaaggatgtggagttgtcccgtgaaggggaacagctttatgacaatgcaaggaaaatgctgcagttggaaaaaaatatcctgcgtgatttcacacagaaggatttaaaagcggcaaataaaatcacagtgggcgcctctacggtgccgggacagtatatcctgcctcagatcctttccctgttttccaggacctatcccggaaaccagctggagttaaaggaggcggacagcatggaggtggttcggatggttcaggagggccaggtggaagtggggtttacaggaaccctgggctctgatcctacctgtgtctttgaacccttttattttgaccgtctggtgatcatcactcccaataatgacaaataccgccaatatgagaaaaccgggttccccatggagcagttttatgaagaacggtggatcgtccgggaagaaggttcgggcacgagaaaggaagcggagcggcatctaagggatatgggggtggatttaaaccgtctggaggttgtagccactatcagtaaccaggaaaccattaaaaaatccgtggaagcggccatgggcatttccatcatatccggtgctgctgtggatgattttgtagagcagggctccctgctccgcttttcccttggagtcgaggaggtttaccggaaattgtatatggtttggagcaaaaatcataagcctggtaaggctgccagattgtttatacgttttgtccgggagctgtatgcatatttatagaatctttctatagaaaaagaatgatcagtgaagcaggaatgacaaaagaaacgcaggcaaaaaatatgagaaaaaaagaacagaaaattgttatcaccttccgcaccacggcagaggccattgccctggaatcccaatgccagaaagaagggataccgggacggctcattccggttcccagagaaatctcctccggctgcggactttcctgggcaatgccggtggattggtcagggaatattggacagtggatggaagagaggggactccgctgggataagtacggagagtacctgatttaatatctggaaaacgacatgtgaaattattaacaaacttaagaaaaaaggagtcagaaggagacggctgcggcagtttctttctggctcttttttaaaaaaataatggcgtaagatttatttatagaaaaaatctattaattatttaccgacaatttgtgccttattagtaagaatagtataaaattagatgaagtgcacaaaaataaaaaaggtattgacaaatagttgtacaatatgatatagtcaacctgtcacaaattacaggatttttcagtatcagtattcatcggaacttatatatgctcataattggttgagcgtttctaccaactaccgtaatagttgcctataagtttccacgccataatcagcccggtttttttccgtgtgtttatcatgcgcgtgtgaacaatatagaaatagcggtagttttttattgcgcagaattttcggaattggtgggacactgcaatcagggctgccgtattttatatttttgatacggaataggaggttctatgactggtggtaataattttgtattaaaagggaacatttgttatagtggagatgcccgcactttaaagacggtggaacagggatacttagtttgtcaggatgggaagtccgcaggaatttttaaggagattccggagcagtttaaagaataccctcttgaagactggggtgaccggctcattgtaccagggcttgtggatcttcatatccatgcacctcagttcgcctttcgcggcatgggaatggatttggagcttttagactggctgaataccaatacctttccggaggaggcaaaatacgctgatctggaatacgcaaaaaaggcttatgggatttttgcggaatccatgaaaaaaagcgctacgacaagagcctgtatctttggtaccatccacaggcaggcaacagagcttttaatggatctgatggaggaaacaggcttaaggaccatgatcggcaaggtaaacatggacagaaattcccctgattatttacgggaacaaagtgccgaagagtcagagcaggagacccttctctggctggaagaaacaggctctaagtataaaaatgttaagcccattctgacaccccggttcattccatcctgtacggatgagctgatggaacggctggggcggatgcagaaggagcacgggcttccggtacagtcccatttgtcggaaaaccagggagaggtagcgtgggtaaaggagctttgcccggcttccagattttatggagatgcttatgatcaattcggcctgtttggaggaaacgggaagacggtaatggctcactgtgtttcttcgtcagaagaagaaattgaattaataaaagagcgtggggtttatatcgctcattgtcctcagtcaaacaccaacttatcctcaggagttgctccggtcaggacctatttagaccggtcggtgaatgtggggttgggaagcgatgtggcaggggaagcggggaatctattttccgtgccatgtcagatgccattcaggtgtcaaagctgagatggagactgcaggatgaaagcttaaagcctcttacagtggaagaggcattttaccttggaactttaggcgggggttccttctttggaaaggtgggaagcttcctggaaggctatgaactggacgcgctgattctggatgacagcagtttgccccatcctcagacccttacattaagggaaaggctggagcgcttcatttacctgtctgatgacaggcacttaaaagggaaatatgtggggggaaacaggattttctagttttacttatcaagagaagaactgcatggggcagctcttatacagcaaggaaaatattctaactatcaaggaggtagaggtatggaaacaaaaaaaagcggtgggctcttagagagggtatttcacttatctgagaatcatacggatgcaaggaccgagatcgtggccggtgttaccacattcatgaccatggcttatatcctggcggtcaacccaagcatcttaagcgctgcgggtatggacagcggggccgtatttacggcaactgctcttgcatcactgtttgcaactctgttaatggcaggacttgcaaattatccctttgtattggcaccgggaatgggacttaatgcgtattttgcatatactgtagtccttaacatgggctatacctgggaaatggctttggctgccgtattcattgaaggtcttatattcatcgctctttcactgactagtgtccgtgaagcgatcttcaatgcgatccctgtaaatttaaagcatgccgtatctgttggtattggcttgttcatcgcatttatcggacttcagaatgcgaaaattgttgtggatggggcaactcttgtaacaatgttttctttcaagggttcccttgcggatggttccttccataccgttggcattaccgtattactggcgatcatcggtattctggtcacagccgtactggtagtaaaaaatgtaaagggcaacattttgtggggaattatctttacctgggttttaggcatggtctgtcaggcaatcggtttatatcggccaaatccggagcttggaatgttcagcgttttccctaacttttcatcaggtttcggtattccggacatgagccccacttttttaaagctggatttctccagggtaatttctctggacttcctggttgtcatgtttgcgtttttgtttgttgatatgtttgatactctgggaaccttaatcggtgtagcttccaaggcagatatgctggataaagacggaaagcttcctcagatcaagggcgctttaatggcagatgccgttggtaccgctgcaggtgcattattcggtacatccactacaaccactttcgtagaaagtgcagccggtgttgcagaaggcggcagaaccggattaacggcagtggttgccgcaatcctgttcggtttatccctgttcttatccccaattttcctggccattccgtcttttgcaacggctccggccctggtagtggtaggtttcctgatgctgacctccgttatcaagattgattttgcggatttcacagaagcaattccatgctacatcgcaattattgcaatgccttttatgtacagcatttccgagggaatttccatgggaatcatctcttatgtggttattaacgtgattaccggaaaagctaaagaaaagaagataagtacccttatgtatgttttagcggtattgtttgtgctaaaatatatactaatatagttataaaaagcaacccaataaagcagcctgattaaaatcagaacatccggtcaacagatatggactggcggcgacatcactttgataagcatttcatgctttgaaaaagtctcgtctccgtcggtctttttcataaggggaaggaccggaagctgttaacacaacagaatcagaaataggaggcgtaaatatgataatcggaaaaagtgttacccgtgtggatgcatttgataaagccacgggaagatccaaatacaccgatgatctctgtgagagaaatgccctggtagctaaaatctaccactcttccatagccaatggaaacgtaaaatcgattgatacttcagaagccgaaaaaataccgggagtggtcaaagtagttacctgttttgatgtgcctaagaactattttccaacggccggccatccctggtcaacggacatctcacatcaggatgtggcggaccggcttcttttaacagaccgggtgcgtttttacggtgatgaggtagctgcggtgatcgcggaaaatgaaatagctgcaaagcaggcgatcagggccttaaaggtggaatacgaggaatatccctttgttcttgatgttcaggaggccatgaaggatggggcacctcagcttcacgagaagtatgtcaataatattctgggccattccagtatcagaaaggggaatctggaagaagctattaaagagccgggacttgtaaaaattgaccagtggtacgatactcccatcgttcagcactgtcatattgaaaaccatatttgttttgccagcatggaaaacggaaaaattaccgtggtttcttctacccagatccctcatatcgtcaggagagtggtagggcaggcccttggaatcccctggggaagtgtccgcatcatcaagccatatataggaggcggttttggaaataagcaggatgctttgtatgagcctctttgtgcatacctttcaacggcagttggaggacggctggtcaagcttgatgtgacccgtgaagaaacctttgtaagcaaccgtacaagacatgctatccgcagccatattatcagctgggtgcgccctgacggaacctttgccgcccgtaaactggagtgcttttccaatcagggagcttatgcttctcacggacatggaatcgcggcaaaaggcatgaatgcatttccacagttatatccttgcgaaaatgtagaatgtgatgcctatacagtattcaccaatatgcctgtggcaggagccatgcgcggctacggcattcctcaggccatgttcccggtggaaagccagtctgatgacattgccttgaaaatcggcatggatccggtagaattccgccgtaaaaacctgatgccagtaggctatgtggatggtttttctaaaaatgaaaattactatgacacctttaatcagtgcctgaataagggaaaagcctatatagattatgaccggaaacgaaaggaatacgccaaccagaccggacttatccgcaaaggcgtgggctgcgcagtattctggtataacacggcggtatggccaatcagcctggaaacctcttcctgccggatggtcatgaaccaggatggctccatacaggttcagctgggtgagacggagatcggccagggggctgatacggcttttggccagatggcggcggatactctgggaattccttttgaaaaggttcatgtgatttcctgtcaggatacagatatcactccttttggaacaggatcctatgcttccagacagacttatgtaggaggcttttccatcaaacagacggcgcttatattaaaagaaagaattttaaaatatgcccatgagctgacccgtatgccggtctttaacctggatatcagggaaggaaagatcgtacggaccacagatggaagagaactaatgacgttaggcgaattggcaacagaggccttttacagccttgccaactgccagcatctgacctctgaaagcacttatcagataaagtccaacgcttattcctttggctgctgctttgccgaggtagaggtggatattcccatgtgcaaggcaaagctggtggatattatcaatgtccatgactgcggccagctgatcaatccggctcttgcagaggcccaggtccatggaggaatgagcatgggaatcggatatgccctttcagaacagcttctcattgatgagaaaacaggcagaaccttaaatgacaatctgctggattataaattgtccactaccatggatcatccccatctggaggcacagtttgtggaaaattacgagcctaccagcgcatttggaacaaaatccctgggtgagcccccggcctgtccagtggctccggccatccgtaatgccattttaaatgcaacaggtgtgtccatgtaccagatacccatgacatctcagaatttatttaaacggttcaaggaagaaggacttatctgaatgcaactattaatagcaaggaggaaagctttatgtatgatatgaaagcattatatgaagcaaataccgtggaagaagcggtaaagcttcgtttggaacatcctgaggcccagattattgcaggggaagtgatgttttgatacagatgcgtgagggaaaacgcgccggaaaggaattgatcagcatttatatgatcaatgagataaggggcgtgaaaatggacgaagaagaggccatacgcataggctctctcaccagtttctcccatattaccaaggatcccattattcagaaatacatcaatgttcttggcgaagcggtggatatggtgggcggtccccagatcagaaacattgccacaatcggaggaaatacctgcaacggtgttacctcagcagattcagcttcaacgctttttgcatgggatgccatgatcgagctgacaggccctgaaggtgtccgccggattccaatcagcgatttctatataaaggcaggaaccgtggatatcagagagggagagcttcagaccgcagtgatcattccgaagaaaagctataaaggctataaaggccattatatcaaatatgccaacagaaatgccatggatattgccaccacaggctgctccgtaaatataaagctgtcagaggacaaaaagaccgtggaagacgtgagaatcgcttatggagtggcaggccctattccaatgcgtacgaaaagtgcggaaaacttagcaaagggccagccggtgtcaaaagaactggcagaggcctttggaaaagaagtccttgcagacatcaatcccagagacagctggcgcgcctcaaaggatttccgtaagcacattgctgtggaaatggcaacccgctgtttcatagagtcagtgaaactttcaggaggtgagatctaatgccggtacaatataagttggtaaaatgtaccatcaacggaaaatacacggaaacaatggtggatgtacgggcatccctgaccgatatgttacgggatgattaccgtctgacttccgtgaaaaaaggctgtgaggtaggagaatgcggagcctgtaacgtgatcatagaccatgagtgttacaattcctgtatttacctggccatatgggcagaaggaaaagaaattaagaccctggaaagcctgatgggtccaaatggagagctttccgatattcagcaggcatttatagacgaggcagcagtccagtgcggattctgcacgccgggatttattatgtcagcggtggaaattctggaaagcggaaaagagtatacaagagatgaacttagaaagctgatgtccggccatctatgccggtgcacaggctatgagaatatcttaaatgcggtggaaaaaaccatgctccgcagattgggaaagctgcctgcctgattgcagcttaaaacaaccgaaaacgcaaggccagagcaacgaaacagttgccttgaccttgcgtttttgtttttgtaaaaattactggttttacacattctattaaaaaattcccgaaattctcaaaaacaatgcattttcttatgcattaattaagaaatacgatccccaggtttaagtatgcggcaaaggtgacccacagcaggtaagggatctgcaggacagcagcatcgggactgacagaccagaaggccgctatcattttcaggataaagtaccaaagaaaaaggagaaccaaaaaggccaggagataattatttaagttaaagaacaccaggttccagagaaaattcagcagcagctggattccatataacctgagggactggtttttcctgtgggagggcgaggaagcggccaaataagagccgattcccatgaggatatatagaaccgtccatatgatggggagcagccagccgggaggagaaaaggcaggatgattcaggcttttgtatatggacaagccgttcctcgtcaaaaatccggccaaagccccgaccactaagggaaaagcgatataagcagtacgtatcctttggtttctgtccacatggattctcctgtcttgcatttgttactatcttattcacagagaaggggaatatccatgcgcctcctgaattccctgggagtcataccgaatttttccttaaagatccggttaaaataagacagattgttaaaaccggtctcccctgcaacggtaaggactgaatcctcggaggagaggagcagcctggaggccattgtcaggcggtaatcgtttaaataagcggtaaagggcagccccatggtctttttaaagaatttcataaaatgagactggctcatgccgcaggcccgggatacttcttctatggaaagggattcactgtaatgctgttccatgtatttaagaatctgccgggtccgttccagctccttgggagggcgggaaggagggggaagagaagcttcctcaataccccagagaagaaagaacagttggaacaacttccccttgattaacagttcatagccttcaggaaatgtttcccggatctggtcgatccggtccaggcaggaagcgatcccgctgtaaccgggaaggcttttggtcatgagtaccggaagttttttttgtccccggatgatgggagagaagtaagtttcccagcacatatccggctgcctggaacctaacaggcttaagttgaaaataatgttctcatactccatggattcctgtttccattgctttatggtatggagctttccggggcagaccaggacaatatctccagcctggacctcatatgggacaaagtccaccgagacctgcccggttccttttttgatatagatgaattccatttcatcatgccagtgaaggggaaccttgttaaaatccagggggatggtgcagggataagtcaggtaaggaaaatcggaagggtcctgttcccgtttttcctgatagttttcgtactgtatgatattcatagaactcctgtttttcgtgatatttcagcagttaatgatagtattgtaccataataggccagaatgctgcaagataaacagcagcaggaacattataatactagggtaaggttaaagaaaacaaaaaaggagtggtttcaatgaatcttgaacaacaaatttttgaaatatacaaaaaaacagtgaaccagtgttccaatcaggaaatttattctgcgctgctgaaaatcgtggaggaggaaggaaaaaagcggcaggaggaggaaggaaagaaaaaggtatattacttatctgcggaattcctcataggaaaactgctttccaataacctgatcaaccttggaatctatgatgaagtaacccgggttcttgctgaaaacggcagggatatttgtgagattgaggaaatagagccggagccatcccttggaaacggcggtctgggacgccttgctgcctgttttctggattctatggcaacccttgggttaaacggggacggcattggccttaattatcattttggcttgtttaaacagacctttaaggaccatcttcaggcagaagaccctaacccatggatagagccggatacatggcttaacaggacagaagtcacttatccggtcacctttggcagtctgaccgtccgttccagaatgtatgacataggggtgaccggttatcagggacgcaccaataagcttcatctgtttgacttggagaccattgatgaggagcttatagaagatgggatagcctttgataaagaagccgttaaaaagaatctgaccctgttcctctatcccgatgacagcgatgaggccggcagaaagcttcgtatttaccagcagtattttatggtaagcagcgctgcacagtatatccttgatgagtgcgttaaaaagggatgcaggctttatgatttgccggattatgcggtgatccagattaatgatacccatccatccatggtgatcccggaactgatccggcttttaacccttaggggattccttttgaaaaggcggctgaaattgtcagcagaacctgtgcctacaccaatcacaccatccttgcagaagcccttgaaaagtggcccatggagtatttggaggaggctgtgcctcagctggtgcctgttatagagaagctggataaacagatccgtaaatcatataaagacccggctgtggcgatcattgatgaaaaggatctggtgcacatggcccacatggatatccactacggcttcagcgtcaatggggtggcatatcttcatacggagatactgaaaaaaagcgaattaaagaaattttacgatatttacccggaaaaattttccaataagaccaacgggatcaccttccggcgatggcttctccattgcaatccccggctgtcggaactcattgcctccagaatcggagagggttataagaaagatgcaatggagctggaaaagctggctgcctttgacgacgaggcgactttaaaagccattctggatataaaaaagcagaataagaccgctttgaagaaatatcttatgtcaacccaggagacggacatagatgaaaattccatttacgatatccagatcaagcgtctccatgaatataagagacagcagatgaatgccctctatgttatacacaagtatctggaaataaaaagaggaaacttacctgcaagaccggtcacagtgatcttcggtgcaaaggcggctcctgcctatgtgatagcaaaggatattattcacctgatcctgtgtcttcaggagctggtgaacaatgatccccaggtgagcccctatcttaaggtggtaatggtggaaaactataacgtatccaaggcagaaaagctgattcctgcctgtgatatttcccagcagatttcacttgcgtccaaggaggccagcggaaccggcaatatgaaatttatgttaaatggagcagtgacccttggaaccatggatggagccaatgttgagattgcagagctggtgggaaaggataatatttatatcttcggagaatccagtgagaaagtgatccaacattacacaaaagctgattatgtggctaaggagtattataaagaggatgcacaaatccgggaagctctggattttatggtgggagcggagatgacttccatcggtcataaggaaaatttaaaacggctttatgatgaaatcctgaaaaaagactggttcatgaccctgttggattacaaggcttatgaggaagccagggaaaggatttacagggattatgaggattcgtttgcatgggcgaagaagatgctggtcaatatcagcaaggcaggatatttctcttcggaccgtactattctggaatataaccgggatatctggaagctgtaaaaaagccgtctagtgaacaataaaaaaagcccttctgctgaaagttttggcttaaagcagaagggctttttgttaaaatccgtcaaaatggaactcagcggaaattgcggttaacatgttaacataaggatgctttgtttcattacacatcttgcatagcagcttttgccttctctttatcttctttagtcattgggaagcaaatgcttgcaacgattgatacgatacaacacacggcagccggtgcgctcattaatggcgcaatggcatgtaagagtggttgaatgaacgccgggaaggtttccacggccaggctcatggaggtaagtccaataccaaatgcaagtgtaataccgataatagttacgtttctctcggagaaacctgctttggcaatcatcttaataccgtttaatgtgatcatagcaaacacagaaataatggcgccgcccaaaaccgcatcagggatggtttggaaaagagctgccaatttcgggatgagtccgcacaaagccaggaatacagctcctacggcaacgcaccatttgttcacgattctcgtcatggaaatgatacctgcgttctgtccaaacgcggtgtttggcagtgcgttaaatatagctgccaacatcgatccacccgcatctgccaggatggcaccggaggtttcttcggaggtaggttccctgtcaaatgccgcaatggtgataccgccggtgttaccgatggtttccaatccggaaatgatataaaacagggcgaagtttaagatgccggctaaggagaatttgaggccgaaataaaacggcgttggtacggagacgactttagcggctgtgatcggcgcaaagttcaccatacccaaggcaacagacaccacatatccgatagccagtccaaaaagcagggcggaattcttcactatacctttgccatatttttggagcaataacacaaggacaaatacaaataatgccatgcatacatttttcatggaaccaaacacgcctgtaaattgaaacttgtccggattctcattatacgcagccaaatttgcagccgcgtttgaaccgccgttaaagtatcgcgctccagcgcttaataagtttaatccaatggcaataagggttgttcccaccacgataggtgaaaataaatcggaaagcttcttatagaagaaacccataaatacttcaacaagaccgcctacaagtgaacagccgagaaccaacgcgtatatatcacgcggatcggtcagtcccatagaaggcgcgacttgagtggcaacaatggaagccacggaaacaaatgcaaacgatgtccccatgacaatggggagattcgctccgatacggaagctctttcccagcttgagcggatacagctgaaacaaggtggttacaccggatacaaccatggctgatgataacataaccgttttatccgcaggttccagaccacagatactggcaatgatgagtatgggggctaagttgcccgtaaacatggccagaatgtgctgcagacccagtgggaatgcagtttttaagcttggcctgccttccagttgatagattagttctttgtcgttttgcttacccatagataatccctctctttattgtgattttcaaagccaaagagggactgtttagagttaacttggacagttcccagcttccaaagaagagagccccagctagtaataaccaatccggtcttctatgatggtcaatggctttgaatgttggtattttacctaacaaaagtttcacttatgaatacgagttccggtcttccccaggattccctctttagctttttcaagcaaagtgataagcgcattgcgaccctctttggaatctgcgaatttcacagcagcctgaacctttggcagcatggagccaggagcaaaatgtccttctccaatgaactgacgtgcctcgtctgttgtgatatcgtccaaccatttctcttccggtttaccgaagtttattgctactttctcaactgctgtaaggatgattaagaaatctgcatccagttcttctgccagcagttcacttgcaaaatctttgtcaattactgcgcttgcgccttttaagtggtttccctgaagggtaacgggaattccaccgccgccgcaggcgataaccagctgtccggattccacaagggagcgaattgcgccgatttcaatgatttctgcaggatttggtgaagctaccacacggcggtatccccgtccggcatcttcttttgtaatatatccgtatttttcctcagccagctttgcttcttcctcagtcatgaagtgaccgattggcttgctgggagagttgaaggcaggatcgttttcatctacacgaacctgtgtgatcatggtggttacgggaatgttggtgaggttcctgtttaccagttcttctctcagggcattctgtaagtcatagccgatataagcctggctcatggctacacagacggagagaggagtgtttggctgtttgggatcttcccgggttaaagcgctcattgcgttattaatcatacccacctgtgggccgttgccgtgaaccaccactacttcacagccttcttcgatcaggtcaacaattgcttttgacgtgatctttactgcagtcatctgctccggtaatgtgttgcccagggcattgccgcctaacgcaataactattctttttttctttgccattttgctgtcctcttaatgattaagaattttttaaaagacgcaccagtatcctttgaataggctgcaggtgcgcctggaattcttaaatatagggcaattgcccccgtatgaaattattcaaaaattcttggtgatttcttttcttccagcttttttaagatctcctgtggattgccgaatttgcttaagaagatcatagcagcgattacatatggcttgtagcttgcttctttgtataacggatcgcggtaacgatcgaatacagatgcctctacttcgccgtctacacagcttacatcgttgatgtcagcaggtaagcagtgcatgtaaagagccttgccgtcttttgttgtcttcattaattcttctgtacagcaccagtctttgtgctgagcgttctgagccagtaattctttctcaagagccttgatgccgtcggaatcgccttcagcgtaaaggttggttctcttttccatagcagcaaatggagcccagctctttggatatacaacatcagcatccttgaatgcgtcagccatatcgttggatacacggaaggaaccgccggatttctctgcgttcttcttagctatttccacaacctctggcataacctcataaccttccggatgagccagaacaacttccatacccatacgggtcattaagccgatgattccctgtggtacggataatggctttccgtaggaaggagagtaagcccatgtcattgccagctttttgccctttaagttctcaaggccgcccagctcatggatgacgtgaagcatatcagccatactctgggtaggatgatcgatgtcacactgtaagttaactaaggtcggtctctgctctaaaatgccgtccttgtttccctgggtaacagcgtccatgaattcatgcatataagcatttcctttgccgatgtacatatcatcacggataccgattacgtctgccatgaaggaaaccatgttagctgtttcacgaacagtctcgccgtgagccacctgggatttgccctcatctaaatcctgaacttccagaccaagtaagttacatgcggaagcaaaagagaaacgggtacgtgtggagttgtcgcggaataaggagattccaaggccgctttcaaatactcttgtagaaatgttgttctctctcatgaagcggagagcatcagcaacggtccagacagcttccagctcgtcgtcagtcttttcccaggttaagaagaagtcattctcatacatctccttaaaatttaaggaattcagtttgtcaatgtaatcctgtaaggttttcataaaatcgttagcctcctgattttttctttgttttattggtatctatccttcatgcagcctgccaggcattgattggggaaggaatgatcggcagacggcaaaaatgattgttaggagcggcggcaggcctttataaggcccgctgccggaattatggttccaaaatggttcctgaatagcttgtctgtttatttgcagtatgcgcttggaagtgctgcatatactgctgcacatgttacaagatcctgtttccaggtcttctcgttaggagcatgagcctgagcctctgcgccaggtccgaagccgatgcatgggattccgttacggcccatgatggaaacgccgtttgtggagaaggtccacttatcggtaagaggacgggcggttctcatagcaattgtttcttctgcaccgattctgacatcgccgtaaaggttcttgtaagcttcttccagagctgcggtaacagcgtgatcctccgggataacccaggttgggaagtagcactcgatcggataggtaagtcctgtataggaaggacgggaatattcgtacatggaaacagtcacatcatcgccgtatttctttacgtttggaagattacggatctcatccagacagctttcccatgtctcgccggcggtcatacggcggtctaaggatacggaacaggagtcagcaactgcacagcggcttggggaggtgaagaagatctcggaagcagtaacagtaccgcggcctaagaagttagcttctttccattctttgttgtacttctcatcaagcatctttacaaggcctttgatttccttgtcatcagcagcgtcgttctcgttaagagagcggacatcctgaagaatatcagccattttatagattgcgttatcaccgcgctccggtgcggaaccgtggcaggagataccctttacgtcaatacggatttccatacggcctctctgtccgcggtagataccgccgtcagtcggctctgtggaaacaacgaattccggacgaaccttgtcttcgttgatgatatactgccagcaaagaccatcacagtcctcttcctgaacagtaccggttaccagtacggtgtacttgtcatttaaaagacctaagtccttcatgattcttgcgccgtaaacagcggatacgataccgccgcactgatcagatacaccgcggccgccgatttctgtgtcattttcgtagccttcgtatggatcaaatgtccagttgctcttgttgccgataccaacggtatcgatgtgagcgtcaaaaccgattaaagttttgccggttcccatatagcctaatacgttgcccatgccgtcgatttccactttgtcgaaatccagcttccgcatttcttctgcgatgcggtcgatatgagctttttcatcacagctctcgcctgggaatttaacgatttcccgtaagaactttgtcatgtcggcttcatagttttgtgctgcttctttgattttactgtaatccatatttttgtcctccattttataatttattaagaaatatatgcctaacgttcttttccttcccagacaattgctttgtaacgatccgggtcggtgtcaccctcagtagagaagaggagaacttttgaatccttattaagtcctaaatgctcccttaattccttgtactcatcaagaagcatgatgcaggtcaaaactccgaaaggagcagcgcctgattcaccggaggttaccggtgcatcacctttgacaggagcggcaagcattctcataccctgtgcggctacccagtcaggagcggaaacaaaggtatctacgtgattctttaagatatcccaggaaattgtgtttggctctccgcaggcaaggccggccataatggtctgcatatccccgtctacaatgcggatctttccgtctccggcttttgctcccttatagagacagtcagccacatcagcttccacaaccacaaccttaggcgggttctcaggataacggttagcgaaatatccctgaacagcgcctgcaagagaacctacgccagcctgaacaaatacatgggtaggtctgtcgcagccatattcctcaagctgctcattggcttctaaagccatggttccgtaaccctgcatgatccaggcaggaatctcttcgtaaccatcccaggcagtatcctgtaccacaacgccgttctttgttttggaagcggcatcagcagccatgcggacgcattcgtcataattgacttcttcaatagtaactgttgcgccttctgctttgatgttgttgaaacgggtgatagtggagccctttggcatgtaaacaacggacttctggcctaatctgttggctgcccatgcaacaccccgtccatgatttccgtcggtggcagtaaagaaggtagcctgaccgaactcttctcttaaagcgtcagatgtgagaacgctgtagggaagatcggaaacatcttttccagtctgctttgcaatgtactttgcgatagcaaaggatccgcccaataccttgaatgcatttaagccgaaccggtaggattcgtctttcatgtaaacctggccaaggcctaaataatcagccatgtgatccagctttacaagaggagtcttgctgtactggggaaagctttcatggaatactcgcgctttcttgatttcatcaagggccatgaccggcagattcttatcatcggtctttggcatggtgtttacaacccattcgattggtttcatgattactgattctcctttttcttatttaattatgttacttttctttattcgtatccatataactgtataaagtgaatttggatatgccaaaataattggaaaccttgtcgcctgactttgtgatcaggaatgctccggcatcgtttaaatactggattgcggcaactttgtcgtccttgctcataagggcaacaggtttgcccaccaaagctacggactgttcaatcagttcgtcgagaagatcgttcacattatgagtgattctcctcggctgcttctcatcgtcttctgtttccgcagtggagagaagggattttaaagaattgtctatggtgagcaggcctgtgatatcataattaagggccagaatgtaatcgatggtattatctttccctctaatatacatggtgctggattttaaaatcctgccgtcatcggttcttgttaaataagaaaggcggtcttttaaaagatccgggttcttttttaaggtctcaagaacgatttctgagggaccatctcccagcttacggttgcttacctggccattttcgatatagacaatggagctgtctaaatcttctttccttaaatcatggataactacttcacaattattcccaaaatgagtagaaattcctcgtgcaatttgtgttaataactcaagttttgtatccatcgtttgccctcccctcatggaacttcttatacactcatcatagcataaaaaattaaaatttcaagtggttttctaaaaattttttaggttctctaaattttttttgaattttgacttgcatttctttatatgaaatgatacactgtactcagtaaggaatttatggtgtaatctgtatagaaaatggcgaattatgagagtgagtataagcaggttgcgaaaataaagtgcagccataggggaagaacctatgtgaggtttgtacagttgaaaattttaagatttcacttaaattatgttaaaaaaatcgaaaaaaggagatggaaacatgcttgttatcggtaatggaagaatgattacaagagaccctcaaaatccgttttttgagaacggtgcggttgcaatggaagagggtgtgatccgtaaggtcggaaccacagaagaaattaaaaaagaatatccagatgcggagtatattgatgcaaagggcggggttatcatgccagcctttatcaatgcccacgagcatatttacagttcttttgccagaggcttaagcattaatggatatgatccccatggatttctggagattcttgacggaatgtggtggaccattgaccgcaatctcacattggaagagacaaggttaagcgccatggcaacttacatcgattctattaagaacggtgtgacaaccacctttgaccatcatgcaagcttcggacacattacggattccttatttaagatcgaagaggctgcaaaagaaaccggcgtccgttcctgcctttgctatgaggtttccgaccgtgatggcaaggacaaagcaaaggaagcggttctggagaacgaggcattcatcaagcacgctctggcagatgacagcgatatgattgcaggaatgatgggcatgcacgctcagttcaccatctctgacgagaccatggagcttgcagcttcccacaagccggaaggcgttggttaccacattcacgtggcagagggaatcgaagatcttcacgactgtcttaagaaatacggcaagcggatcgtagaccgtctgatggactgcaatatcctgggagagaaaaccctccttggacactgtatctacatcaatcctcacgagatgcagttaattaaagatacggataccatggtagttcacaatccagaatccaatatgggcaatgcatgcggatgccctcccaccatggaactggtacacagaggtatcttaacaggtcttggaaccgatggttatacccatgacatgacagagtcctacaaggtagctaacgttcttcataagcatcatttatgcgatcctaatgcagcatggggagaggttcccaagatgctgtttgaaggaaatgcaaaaattgcaggccgttactttaagaagcctttaggcgttttaaaagaaggtgcagcagcagatgtcatcgttaccgactacattccgctgacgcccatgaatggggataactgcaacagccatatccttttcggaatgacaggacgcagcgtagtgaccaccgtaggcaacggcaaagtgctgatgaaggatcgtatccttacagccgttgacgaagaaaaggtgatggcagactgcagacaggcagcagccgaattggcaaaacgaatcaattccagataatattttcataaaattcagaaaaaatgtaaaatctacaggatagaatattcatcgagggttgtttgcaggatcagtctgcggacaaccccgttacaggaggtaaaaaatgggagatagaatgacaccaatgccatttgagcagttagtggactggatcgtaaaggaacatgataacagcgggactgttttcggagtctacagaccttataaggcggataagaaagacaacaggaaaattttcggacgcaccttagaaacaccaatgggaccggcagcaggccctcatacccagcttactcagaacattgtggcttcctattattcaggcagccgtttctttgagttaaagactgttcagattttagacggagaggatctgcctgtaagcaaaccatgtatcagggcagatgatgagtgctataactgtgagtggtctacggagctttatgttccccaggctcaggacgaatatatcaaggcatggatcctgcttcacatcattgccaaggaatacggccttggagctatggacggcttccagttcaacatgagcgtgggctatgacttagagggaatcaaatctcctaagattaacagcttcattgattccatgaaggatgcaaaggatacggaaatatttaaatcctgcaagagctatctcctggatcatatggacttatttaagaatgtgaccaaagaggacattgagaacattccttctgagatctgcaattccgtgaccctttccacactccacggatgtcctcctcaggagattcagagaattgcaacttatctgatcgaagaaaaaggactgaacacctttattaagtgcaacccgactcttcttggctacgaatttgcaagaaagaccatggatgatatgggatatgattatatcgcattcggcgatttccacttccttgatgacttacagtatgaggatgcggttcccatgttaaagacccttatggctctggcagagaaaaagaacttggaattcggcgtgaagatcaccaacaccttccctgttgatgtaagaaacaacgagcttccaagtgaagagatgtatatgtccggaaagtccttatatccctttccatttcactggcagccaagctggcaaaggaatttgacggaaaattaagaatttccttctcaggcggtgcggattaccacaacatcaaggcaattgtagatgcaggaatctggccggtaaccgttgccaccactcttttaaaaccaggcggctatcagaggcttttacagatcgcagagaagctggaaggcggcaatgtggagtttacgggagttgatccggtaaaaacggctaagctggcagaggattccattcatgatcctcatcacagaaaggcagtaaaaccacttcctatcaggaagatggcaaagagtgttccccttattgactgctatgtggctccgtgtaaggacgcatgtccgatccatcaggatattactacctatttacagctttccggcgcagggaaatacgaagacgccatgaaagtgatcgcagagaagaatccccttccattcataaccgggactatctgtgcccataactgtatgggcaagtgcaaccggaactattatgaagatccggttaacatccgcggtgtcaagctggtctgtgcagaaggcggctatgatgcgtttatgaaggagatcgaggcaggagaacttaagggcaaaaagacagcagtgatcggcggcggcccggctggccttgcagctgcatacttcctcacaaagaacggcatgcctgcaactatttttgagaagaccggcacccttggcggcgtagtgaagcatgtgatccctggattccgtatttctgatgaggcaattgacaaggatgcagttctgtctctggcatatggagctgaggtaagatacaatacggaagtaacagatttagaagccttaaagaaggaaggctttgattatattatccttgccaccggcgcttccaagccaggtgtgttaaagcttgaggcaggagaaacgatcaatgctctggatttccttgctcagtttaaggctgctgacggaaaattggacattggcaagaacgtggtagtcattggcggcggaaacactgccatggatacggcaagagcggttaagagaacggaaggtgtggagcattcctacctggtttaccggagaacaaaacgttacatgccggcagatgaggaagagttagagatggcactggaagacggcgtggaattcaaggaattgctgtctcctgtagagcttaagaacggaaaactcctttgcaaggtgatgaagctttccgataccgatgctaccggcagaaggggcattgtagaaacagaggaaacagtggaaattcctgcagataccgtgatcgcagcagttggcgagcaggttcctacagaattctatgaggctaacggcattcatgtaagcaaccgcggcaaagttcttgtaaacgaggaaactctggagaccagcgtatctggtgtttacgtggtaggcgacggactttatggaccggctactgttgtagaggccatgagagatgcccgcatggctgctgaagcaattttaggcaaaaaggctgctgttgactttgatgatacagtggacaacttaggcacgatttatgataaacgcggtattcttgaaggaaccaaggaatatacggtagaaggctccagatgccttggctgttctaatgtctgtgaaaactgcgcggaagtctgtccaaaccgtgcaaacctggccttgaatattcctggattatccatgcaccagatcgttcatgtggactatatgtgcaacgagtgcggaaactgtaagagcttctgtccatatgacagcgctccttacttagataagttcaccttattcgctaacgaggctgatatggaaaacagcaagaacgaaggctttgttgtaatggataaggcagagattgcctgcaaggtgcggtaccttggaaacattcttacctggaaagccggtgaaaaggacagcgtaattcccgatgggcttagaaaagtcatggaaactgtctgcaaagagtatgattatattttaggatagtcaatatcctgaagtaaaaagaaaaagtaattgtattggaaatgaatcggcgcagtcggagaagcagctttctccctgcgcctttcaatcttggcagatgaacctccttccagggatccctttacgcccgataaagcggggcgggcattgccctggaaagacgggcggaatagatgaaaacagccatcccacggaatcagagagcgggccgtaaaaaggctgagacagcgaaaagaaaggaagtagatgtttatgaaaaccctattaaagggcggaaccgtagtttcgggaagcggcgtcattcaggcggatgttctcatggatgaaggaaagatccaggcagtggaaccggaaatccaggcggagggagcaaatgtcattgacgtaacaggaaagcttttgttccccgggtttatcgatgcccacactcattttgatctccatgtggcaggaaccgtgacagcggataattttgaaacgggaacaaaggccgcgctgtcaggcggaaccaccatgatcattgattttgccacccagtatcagggagaaactctggaaaaggccctggaaaactggcataaaaaggcggatgggaacgcatcctgtgattatggctttcatctggccatttccgactggaatcccgctgtcagcaaggaattggaagaaatcgttgaaaacggcgtgacctcttttaaactttacatgacttacgatgaaatgtacttaagtgataagaagatctatcaggtactgaagcggttaaaggaagtaggcggaattgccggcgttcattgtgaaaacatgggaatcatagaagcactgaaagaagaagagaaagcaaagggaaatttatctgtcagcgcccataagaaaaccagacccgccccagtagaggcggaagcaatcggcaggctgttaaaaatctccggccttgcggatactccggtgatcatcgttcacttaagctccggagagggttatcaggaagtgaaatatgccagagagaggggccaggaagtttatctggaaacctgccctcagtatctgcttatgaatgaaagtgtttatgaccttcccggctttgaaggcagcaaatatgtgatctcccccaccattaagaaggaaaaggactgcatcaggctgtggaatgccattcttaagaatcatatccagaccatagcaacggatcactgcagctttaccaccagccagaaggcggcgggaaaagaggactttacaaagattccaaacggaatgcctggagtggaatcccgtccggtcctcatgtacagctttggagtcctggagcacaacttaaagctggagcagatgtgcaggctgctgtctgaaaatgcggcaaagctttatggcgtttatccccggaagggcgccattgctcctggaagcgatggggatatcgtggtgtggaatcctgatgtccagtggacaatatccgtggaaaatcaggtggcaaatgtggattattgcccctttgagggaactgatgtcaagggaaaggctgagcttgtattcttaaagggaaatctggctgcaaaagacggtcaggtggtattggagaaaacaggttcctatgtcaatagaaataggcgtatggagttgtactaatgggtgcaaaaagtgtttataccatgaaaaaccaggagggaaaaccggtcgtgaccaggaggacttccctgtgggaagccctggggtttccgcttaaggaccatatggtcatttcctttaccggcggcggcggtaagaccagcgccatgtattccctggctgatgagctggctcacatgggaaaacgcgtgatcgtcaccaccagcacccatatcttttgtcctgaggaccgggaggtagtgccggcagaccgggctgaaaccgttaaagaatttctaaagggccgggaaaaacggcattctgaccgggtgggccaggttctggtaacaggacagtctgcagccgggggaaagttaaaaggcatggatctccgggaaatggagcagcttccggatcttgcagacgtgcttctggtagaggcagatggagcaaaacgcctgcctctgaagatcccaagggaaggggagcctgtgcttttaaaaggcacccatgtggtgatcggatgtgccggactggatgccataggctgtccctgggaagaaaagtgcttccggtgggagcttgcagaacaggcatttggctggcagacggaaaatagtctgatcaccccggcccaggccggcagaatccttataagcagccaggggaccagaaagggagcagaatccatggagtaccggattttgctgaataaagccgataatgaagccaggatatccgacgggatccgcattgtggaatccctgggggaagaatggaccggacgttgtgtgatgaccagtttttttaccatagagaaggatcagaatggaagaaataaagcagcaggaaagaaatcttaagtatcatttaaagcttcgtgtttattatgaagagcgtaatttcggtcccggggtggcagacttaatgaagctggtgagggagaggggatctctttcggcggcttgccaggaactgcatatggcttattccaaggcctggaagatcattaacaaggcggaagaggatctgggattttccctgatggaaggacgaagaggaggagaaaacggaggaaataccgttttgactccccagggcgaaaagttcttagagcagtatctggccttttcacaggcagtggaaacggcggcggaagaattattttacaaatatttttcctgatgatataatgaaaggatatggagtttatttgcaggggggatattcttacatgagaataacatgctccataaggaacgaaaggagaggggaacatgaaggaaatcaaaaccatagattcggtggggcaggtgctctgccacgatatgacccagatcatacctggagtcataaaggatgcaagattcaggaaaggacatgtagtgacagaggaggacattccggtgctcctgtccatgggaaaagaacatatatttatatgggaaaaggatgattccctgtatcatgaaaatgaagctgctgaaatcctgtgcagtctttgcttaaatgaccatatggagcgcagtcaggcaaaggaaggaaaaattgaattgaaatcaactgttcggggcctgttaaaaatagataccggacttttggataaaataaacagccagggaaacatgatgatcgcttccagacaccccaacactcccgtagagcctggagacaagctgtgtggaaccagaatcattcctcttgtcattgaaaaggaaaagatggaagaagtcaaagacctttgcggcggaaagaagatctttgctatattgccttacctggacaaaaaggtagggctggtgaccactggaagcgaggtattccacggaagggtaaaggattcctttggtcctgttttaaaggcaaaggtggaagagttcggtggtaaaatccttggacaaacagtcaccgatgataaaccggagcacaccacgtcagcgatccttgaatttatccggcagggagctgatatggtgctcgtcagcggagggatgagtgttgatccggatgacaagactccccttgccatccgcaatacaggggcagaggtgatatcctacggtgctcccgttcttcccggagccatgttcttactttcttattacagaaaggacgggaaaaaaattcccatagcagggcttcccggatgcgtcatgtattccaagagaacggtatttgatctggtgcttccaagactcatggccgatgatccggtgacaaaggaagaccttgacaagctgggaaagggaggactctgtctttcctgcgatgtctgttattatccaaactgcggttttggaaagggttggtagacactaccgattaaattcatcaggaggcatagaatgaacggactgacacattttgatgaacagggaaacgcccgcatggtggacgtaggtgaaaaggcggagacagaccggatcgccgttgcacatgggtttattacggtcaatgaggaagtttttaacgccatttcctttggtaccgcaaaaaagggcgatgtcctgggagtggccagggtggccgggatcatgggggcgaagagaacctctgaactgattcccctgtgccatgggctgatgcttacaaaatgcgcggtggattttgtgcttcaccgggaaacactttcggtggaggcggtctgcacggtcaagacccagggaaagaccggggtggagatggaagccctgaccggggtgaatatcgcgctgcttaccatatacgacatgtgcaaggcaatggaccggggtatggtcatcagtgatatctgccttttaaaaaaggatggcggcaagagcgggttatatgaaaaggtctcagatggcagagggagcggatcatgaaagacagctgtaacagaaccattgattatatccggatttccgttacggaccggtgcaatttaaggtgcctatactgcatgcctgaggagggagtcgtccccatgcgccatgaggacatcctcacctacggggaaattgtaaggatctgcgaggcaggcgcccgccttgggatccgaaaggtaaaggtgacgggcggagagcctttggtgagaaaggatatagaggttctgatcaaagaactgacagccattccgggaatccaggatgtgaccatgaccaccaatggctgcctgttaaaggaaaaagcggccgcattaaagtctgctggcttatccagcgtcaatgtgagcctggataccctggatcctgtgcgttttgctaagatcaccaggagggattcctttgaatccgttgtggaaggaatcgaaagcgcattggcagcggggctgaaagtaaaaatcaactgtgcggtaatggaggagctgacaaaggaagatgtgctggcttttgcccgtttttccatggaacgcaggatcccggtccgttttatcgaaatgatgcccatcggccagggaaaaaattataaggcaatggaaaacgacgatttggcggagatcttatcagaggctttcggtgagcttagggaaagccgggaggtaaagggtaacggtcctgccgtttattatacgtggggagagggggcaggttttgtgggctttatcagcgctgtcagccataaattctgcggttcctgcaaccgggtgaggctgacctctgacggctttttaaagctttgtctggacagccctgttggagtggatttaaagggacctatgcgcgccgggatttccgatgacagtctttttgagctgatgaatcagagcatcaggaataagccggaaagccatcattttgaagaagactgtggggaaacaggccttaacatgaaccaaataggaggataagcagatgggaaaggtaatggctgtctgtatcagtgaaagaaaaggaactcagaaaaccagagtggatgaaggatattttatagaagaatacggaatcgaaggagatgctcatgcaggcaaatggcaccggcaggtaagtcttttatcctttgataccatcgaggattttaaggcaagaggtgctgagatcggaaatggagcctttggggaaaacgtcattgtccagggcattgatttaatccatcttcccatcggtaccagattagcctgcaaagacatccttttggaagtgacccagatcggaaaggaatgtcacagccactgtgagatatacaagaaaatgggagaatgcatcatgcccactaacgggatctttacaagagttctccatggagggattatgaaggaaggagatgaaattaccgtatgtaccgaggaggaatcgtaaccttaagtgataagggagccgccggagagcgggaagatgtaagcggcgcagtcataaaagagatactggaaggtgcgggctttgaagtggtcagctacagacttctggctgatgaaggagaggagcttaaggaagagcttatacgcttaagcgatgaagtgggctgcgatctggtcctgactacaggagggaccggtttttctcccagggatgtgaccccggaggccactctttccgtcgcggaccgcaatgcaccggggattgccgaggccatacgggcttacagcatgacagtgaccaagagggccatgttaagcagaggtgccagtgttatccgtggatcgaccctcatcatcaaccttcccggaagtcccaaagcagtaagagagagcctggaatacattctggatactctttcccatggtttggagatcctttcaggcagaggcggagaatgtgccagaaaataaataggagattcggagaatcataatgaaggtattgataaaaggggccggcgacctggccacaggcattggctgccggctgcaccgatgcggttttgacctggtcatgacagatattgccgttcccactacggtacggaggacagtggctttttcaagagcagtctacgaagaaaaggcaaaggtggaagatgttacaggagttttatgcaatagtctggaggagatccgtgaggctgtcgcaggggacaaagttgcggtgatcgtagacaaggaatgcaggatcagggaaacatggaagccggatgtggtggtggatgccattattgcaaaaaagaacctgggaaccttgatcaccgatgcagctgtggtggtgggcgttggacccggctttaccgcagggcttgactgccatgttgtggtggaaaccaaacgtggccataacctgggccggtgcatctgggagggaagcgcttatcccaatacaggtgttccgggcatgatcggcggctatgacaaagaaaggatcatacgcgcaacggctgacggagtgtttagaggccaggtcaggatcggtgatctggtggaaaaaggcggcctggtgggctattccggggattctcctatttatgcccaggtgggcggcgttgtcagagggctgcttcaggacggcgtggaagtgataaagggaatgaagtcaggagacgttgatcccagagggatcattgaaagctgctatactatctcagataaagcctcttccatcggcggcggtgttctggaggcgatcttaagcatggagaagaaaagaaggcgggaggctcctgaaagggaaaaataatgatgggaaagggaggtttatggcatgaaactggcacttatccttctggcagcaggtgacagccgcagatttaacggcaataagctgcttcatgaattcaatggaaaacccatgtaccaatatattttagaggaagtcgaaatgcttcctgatgatctttttgacaggaaagtggtcgtcacccagtaccaggagatcatggactgtatgaaggatcatggctatgaggtggtggtaaacatggagagcagtcttgggatatcccactccattcatctggcgttaaaagctcttgaggaggaagaaacagattatttctttgcagtctgtgaccagccttatttaaaggcagctaccataggaggcctggtaaagggctggcgggacagcggaaaggggatcggttgtctgtgcaacatgggagctttgggaaatccggccatattttccaggaattacttaaaagagctgctttcactggaaggagatgtaggaggaaaacggatcatccggaaacatattgaggatttgtaccttcatgaggtgccggacggtttggaactggtggatattgatgtacggaaagattctttgtcctgacctgtatctgattctgttatgtcataaggacatatataataaatagataaatattaaaattatggaggtagtggaatgttaaaaccagttgatttaaaacaagtgcccatggacgcgatcactatgataggaaaggaatggatgctgatttctgccggaaaccaggaaaagtataatatgatgacagccagctggggaggaatcgggatcatgtggaacaaaagtgttaccagcattgttctccgcccccagagatataccctggaatttgtggatcaaagtgattattacgctctcagttttttcggtgaaaattgcagatcagccttaaattactgcggctcccactccggacgggacgtggacaaagaaaaagagacaggtcttactcccgtttttgatgcacaagccccttattttgccgaggccagactggtgcttatctgccgtaagctttataagcagaaaattgatccaaagggcttttttgacaagaccttagatgaacaaaactatcccaataaggattaccatgaacattttataggggagatcgttaaggttttaaaggcagatgaatgaaagaatgttttgatcaataaaatactgtgagaaaccgtaaaaaggaagggtgcccgactgcccttctttttttgcggtgcatgtcatttttggatggaaaaagcggtaatatgtttcttatggaatcaaaatagtgtataatacggaagggaggacagttcttgttttcaccgattaaaggggggattgtatgattaaatggataaaggataaaagggatgctctcaaacacagaggagatccattgaagcaggaaggaattaaaatctgcatcttgtatttactttttggttttatctggatctatttttccgacaaaatcgtgaacaggctggtttacaatccttccacaaggatgatgatccatacctataagggaattatgtatgttttatttactgctgcggtcctttattatctcatatccaaccttttaagaaaggtggaacaggcggaaagcaggctgaacaagagcaacgctgatctgtcttccgccaatgaagaacttaaggaatacgtggatcagctgactgtatcagaatgggaactgaggattcagtatgaaaagatcgtggattatgatcaaagattaaatgtaagcgaagagaaatataaggctgtcatcagccagatgcaattaggcatggcattgtatgagggaagcgctggtgatgacatttttaaatacaggctggtggatgccaatcacagccatgaagttctgacaggattaataaaagaggatattttaggaaaatatttttcagaaatacataaaaacatggagccggaaaatctgggcatgctgatccggaccataaaaacaggagaatccacccgctatgagcggtttcagaggaacaccggttattattatgagatcatcgcgtcacgtcccaagaaaaaccagctggccattattttaaatgacattacaaagagaaaagaggcagaggagcggttaaattacttaagctaccatgaccagctgacaggaatgtataacaggagattttttgagaaagaactgagaaggctggatgtttctgcttactatcccttaaccattaccatggccgatatcaatggtttaaagcttatgaacgattccttcggccatacggcaggagataaatatattcaaaaagtggcacgggtattgaaagcgtgctgcagggaaaaggatatcatatgccgtctgggcggagatgaattcatcatcctttctcccaatacggatgtgaaagaaatcaaagagatcattgcaagggccaatgagcggaccaggcgggaagccgtaaataagatcactctttcggtttcgttcgggtacagcgtaaaacacagggaggatgaatccatattagaagtttttaaaaaggctgaggactttatgtataagaaaaagctgctggaaagctcaggcatgagaggaaaaaccatttacaccattatggcggcgctgcatgagaaaaacccaagggaagaacagcattctctccgggtgtccgagctgtgcgaaaaaatggggacagcccttggcatgcaggaggatgaagtaaaggagctaaagaccgttggccttttgcacgatatcggcaaggtggcaattgaagaagggatactgaataaaaacggaaagctggttgaaaaggaatgggaagaaattagaaaacacccggaaatcggctaccgcattttaagcacagtcaatgagctgtcagagatggcggattacgttctggcccaccatgaacggtgggatggaaacggctatcccaagggactaaaggggaatgaaataccggtccaatccagaatcattgccattgcagatgcatacgatgccatgatcagcgaaagaagctaccgcaaggcattatcaaaggaatatgccatcagcgagctgattaggggcgccggcacccagttctgcggggagtatgtccatttatttatagataaggtggttcaggacatggaaatgagcctgtaaaataaaagagaattttgagcggccctgtttttcatccatttataaaatactgtattgatcttagaaaggcttttcttgattatgttccctgacatttggaaaccctatggttagaatcatccaatgattaaaacagaagggagatataaaatccattgtgaaaatgaaaaaccttaatgaaaatataaaaaccagattaaacaaaccgttttttgagggctggtattttaagcatcaaaatgaagacacggtcctggcttttattcccggccaaagcatagatgaaaggggagggaagcatccgtttttacaaatcatatggaatgaaaactcttatactatggatttttcgcaggaggactgcctgattgacagaaagaacagaagaatcattcttggagacaatatgttttcccctggcggagtaaagctggatattcattcaaatgacatggttatccagggagtgatccgctatggccccttaagccccattgattattccattatgggtccctttcaattggtcccttttatggaatgcagacatgagatcatcagcatgtcccacagcctgatgggaagcttgagggtcaatggaaaggttctggattttactggagaaagggggtatattgagggagaccggggaagatcttttcccagagattatttatggcttcaatgcaaccggtttaaggaagaagcatcggtcatggtttccattgcccatattccttttatcggatacagctttcagggctgtatctgcgtcatccagcataagggcagagaataccgctttgccacttatctgggagtaaaggtggtatgcaaaagggaaacagcagtcatattaaggcagggggagtattcctttaagatatttttatcaaacaggaacagaaagaaagctgccaggttttcccataagcttttggctcctgatcagggaaagatggtgcgttccataaaagaggagcatttattgctggccaggtttttgctgtataaaaaggaggagctgatatttgatttaacaagtgatcacgtgagctttgagtatgtgccgggtccggaaaacggacaatccatatagaaatttggaaaaattttcatttcctgactgcaggtgatagataatttctataagtatagcttatttatagaatttatgaattggacgtaggccttaaatcttaatagaatagaattatcaataaacatgcaggaggatacatgagatgaatgtgaaacaggcagttagtataaagaaaattggggatgatgcggaagatctgtttcgtggaggatttttttgctcagaggcggttgtaagctctatgagatcaaattttgaattggatataccagaagaagtcatagccatggcttccggctttcctgtaggaatcggccgttccaagtgcctgtgcggagcggtatcaggaggagtaatggcccttggcatattctttggacggacaaagcagggagatcctaaggtagagaagaatttagaagtgtcaaaggagcttcatgactggtttaaggaaaacaacgggaagaatgccttatgctgccggatcctgaccaaagagtttgatatgggaaaaggggagcacaaggaacagtgcattcattttacaggactggtagccaaaaaggtggctgagatcgtggtgcgggagtacggtcttaccaataccgatgaactggtgcctgcggagggatgcaatgattaaaaaaattccggttccaatggcagggctttctcttgggtttgctgccctgggaaatctccttcaaacctattcagaatccatccgtctggtatgcggaagcatctccgctatattggcaattttgtttttgtgtaaatgcatttttcattttgatatggtaaaggaagatatgaaaaacccggtgatggcaagcgtatccgggaccttttccatggcggtgattcttctgtcagcctatgccaagccttttatcggcggcggtgcggtctgtatctggtattttggcattgccctgcacgttcttctcatcgtgtattttaccgcgcgttttctttataagctgaatatgaaagccgtatttgccagctattatattgtttatgtgggaattgtaacggccagcgtaacggctcctgcctttgggcaaacaaagctgggaatggtcattttctggtttggcttgatctcgtgcctgatattacttgttcttgtgacggtccggtacgtaaaacacagggacatcgcagaaccggcaaggccgctgttttgtatctatacggctccggtgagcctttgtctggctggataccttcagtccgccgaaacaaaatcaatgacaatggttcttctgctcatggtattagcctgtgtattatatgtggccgtgctgatccgtctgccaagattccttgtcctgcctttttatccaagctacgcggcttttacatttccggtggtgatcagcgccattgcaatgaagatgtcaacggcgttcctgggaaagatgggatatgccgtgggatttttaccggcagtggtccttgttgaaaccgtgattgcagtctgtctggtggtctatgtattcatcaggtatatgaagtttttattcagcagataataagagtacttatagtaagagggtgttgctgaatcaatgccgttaggttaaaacttaatggcattgattcagcggcacccctgttttttattttacaggaaggttctctggactttccggtaaaataaaaacgctccgctttggaaccctgaatgtgtagaatttcaaactttttaatagatacgtccccttaaaacatttccgggggcttgttataatctccataagtgaacgaaacaggttctaagtgaaaaggaggatcattcttatgagaaacaaaatttggatgcggctggccagcctggcctgtgccgggatcatgggggttacattgacagggtgcgggcagaaagcgccggaggcagcaggtcagaaagtggagatttccatgctggatttttttataccaggggaaggggtcacaaaggcgatgaagccgttgctggataagtacttagcagagcatcccaatgtgaccattgatgaagaatcggtttccaacgctgatctggcaacaaaggtgcagaccctggccgcaggggaagaactgcctgacatctttatgatcaaggggcagatggcggagtcatttgtggaaaatgggaaagtatattctttaaatgaggctttaaacggtgatccggcatggaaggataattttaaggagggagtattttccaactttacaattggagagaacatctatgctgtaccgtttcaggtgacaaatacctgtgtattttacaatacggacttattgaaacaggcaggggtccaggagtttccgaaaacatggtctgagctcttggagatcgttccaaaacttaaggaaatcggggtgacgcctatcgtacttggaaataaggagaaatggaatgcggaatccgttatcatgagcaccctgggcaaccggtgtacgggagacgagtggtatcagagcattcgtgaccgcagcggagcgaagtttacagatccggagtttgtgcagtccttacaggctttaagtgatctggccgaagccggggcatttaatgaagatgtaaacagcattgacggcgcccagcagagacagttatatatgaatggaaaagcggctattaccattgacggcagctgggccattgcgaactttgatgagaactgcccggaagaagtgaaaaatgtaacggaaatggcggctcttcccatggtagacggaggaaagggcaatcctgagacaatcaccggaggcgccggctgggctctggcggtaaattccaagattccggaagagaaaaaggcggtagtcattgagatcttaaaggcaatgacagggccggaatacggtacggctgccattgaagaaggaactttgactgctgtgaagccgggagaagaagttaagatcgaaaagaccgtagctgcaaagtttgatgtatttgcaaaggacagaccatttattcctgtttatgatcatcagctgaattcaggcgtgatcgatgtgatgcaaagcgggctacaggaattgctgatcggcagggtttcccctgaggagctggctcagcggatccagacggaatatgaaaacagcggaaagtgagtgacaggaaatgagtaaggcattaagacccaaaaacatagtgatctatggtttgcttgctcctggactggctgtctttatactctgctgcatcgcaccattgtttgtggcagtttataacagcttctttgactgggatggaggtccggtgaaacggtttgtcggggttcagaattatgtggagctggtacaggacagggcattttggagcgcatttaaaaataacctgacctttatcttctggacggtactggggcagatcgggattgcctttctcattgccatgcttctccagtccaggattttaaaatttaaaaatttccataggacggttatctttttcccggtagtattatcggctgttgtggtgggatttttatggaggatcatgtacaactcccaatacggcattgtgaataccatgatgcgtgctgcgggacttggaaatttcatacagctgtggctggatgatccggatattgtgatcggctccctggcgattccaaaggtctggcagtttatcggatactacttgatcattctgctggcagcgatccagggcatcgaccagagcgttctggaggttgcggaattagacggggctaccggatggaaaaagtctaagtacattgtagtgcctctcatcaaaaacacgctgatggtgaccattatgctttgcatatccggtaatatgaagacctttgaccagatttttgtaatgacaggcgggggtcctgggaccagctcggaggtagtagccctgtatgcgtataatgtttccatgaaccgcatgcgttacggctacggcagtacggcggctattggaatcctgattctgagtttaggactgattttgctcagcaggctggttggaagaagaaaggaggagtcttgatgaaaaagatttacagcatggttcaggcggttatggcaaatgcgtttgtgacgctgttttccgtcacctgtatattcccgatcatctggatgatttattcttccctgaaaacggataaggagttttccctggacatattaagccttcctgccagaccggagtttggaaattacgccaaggcgatcaccgagggcaggatcggctcctattttatgaacagcatgttcaataccctgtcagccttagttgtggtgctggtgatttcctttgttacaggctactgtctttccagattccgctttaagggaagaacctttatttattatatgttcctttccggcatgctcattcccatctatgccctgctgattcctatttttgtggagtttaaaactctgggattgctgaacaggaaatttacgctgatccttccctacatagcatttgctctgcccacgggggtatttctggtggaaagctccgtggaaagcgtgcccattgaagtggaggaggccgcctgcatagacggaagctcttttttaaacaccatgttccggatcgttatgcccatgtgcaagccggttttatccacctgcgccattttaaccttcctgcatacatggaatgaatttcctctggcactggtgctgataagaagcaatgcactgaaaacaatgcccatcggtctgaccaattttgtgggaagctacacggtcaattatcctctgatgctggcggcgctggtggtttctaccttaccggttgtaattatgtacttactgttttataatcaaattatgaaaggcatgactgcaggggcggtgaaggggtaataacgttggaggaatgtttaggcaagccagatcatggcttgtctaaacttgtttgcacaggccatgagccgaaggaatatgtttgcaaaaggagcaggtatgaagactaggtttaaaaatatatttggaagcttgcagatggccatatttgccatggtcctggtactgatcctgattcctaccacgattctgggggtgatttcctacggccagtaccggaagatcattacggaaaatgcgaccacactgaatcagaacaatacgactcagatcgccgccaatatggaaggcatcatgagaaacgtggggaacaattctctttcctttttccagaatgaacgggtgagaaatttcctccttgccgatggggaagaagaggtggaaagcgctgcctatgatctggaccgatacgtcaggaaccagctttgctatgaggagtatgtttatgcagtggattttgtccgcatggacggaaaaaggtacagctccacctccatcaccgacggaatcagcaaagaactgcaggaaaagctgctgaaggagaacggccatgctgtttttttaacagatgtgaaagtcagccctgattgggggagcaaccaggaagagctgtacggatatgcaagaagtattaatgacatcaatgacattggcacaaccattgggtttcagaaaatctatataaaaaagagtgtgcttaagcggctgctttctgatcagctgtcagagggtgaggcctactactgtgtggaagacggaatcatccggatttctacggagcaggaaacggaaggctgggagatcgccagaagatttccgggcttgaaactggaatcctctgaaaaccatgatggtgacctggtctatgccagggtgaagtatccgggctggtatgtgataaagaagatttctcccctccaggtggaggatgatgcgtcagtggtacgccagcttctgatttccacaggcattttggcagtgatcctctgcgggatcatgggctttttcctgtcccggtttgtgataaagcccctgggagatttagagtcctccatggggaatctggaagaggatgattttaaaaggaagctgccggaaaatggttacagggaaatatccgtcttatccatggcctttaaccggatgacccttcgcttagatgaactggtaaaccgggtatacagggcggaaatccgggaaaaagatgcccagatccgtgccatgcaggcatacattaaccctcattttctttataataccctggataccatctgctggatgagccggatggagcaggcatttgaaacctgcggcctcattgaggcattgtccaagctgttccgcacttctgtgaaggatacaagtaaaaccaccacagtggcagaggagacggaacacatacaaaattatatcaagattcaggggtgcaggtatacggataccattgaatttgacataatcatggagcctggaacagaggaatgcgagaccgtgcggtttgtcctgcagcctcttgtggaaaatgccattgtccacggaatgggggagcaggagcattccggaatgatccggatcagagcggagagacaaggggaagatctggttctgtctgtggaggatgaaggaaaaggcgccgatgtggaagaattgaaccggcttttggagggagaagtggatggcctgcggggaatggctttattcaatgtacatgaaagggtaaagctgtgctttggagccgcttatggaatccgtttccgggaaagaggaagcaagggattggcagttgaagttgttcagccgtttcgaaaaaggggagaaggaatatgatccgactgatgatagtagatgatgagcccatcatccgggaagggatgatgaccatcattgattgggagagtttggggattatggtagtcggcactgtgggaaatggacgggatggcctggccagggccatggtggaaaagccggatattgtgatcacggatatccggatgcccattgtggatggaatcaaatttactgaggaattgcgtaagaaattgccaaagacccggatcgtatttcttaccgggtacaatgattttgaatatacccgccatgcggtgagggtgggggcggcggactatcttttaaagcccattaacacagaggaactgaccgggctgattcaaaggctggtaaaagagatcagcagggagagcagagagtttgaaagccgcagccagagagcggtcctgctcaaagagaatctgcctctgatgcgcagccgttgcatccatgattttatgtggggaaggacggagaaaaaaagatttttggaacgggccggttatctcggcgttcctttagaggaaaaaaggttccggatccttattttttgcattgactattatttccagcttcttgccaacggggaaagggaagcagatttgcttaagtacgccctgtccaatgtgacggaagagcttgcgggacggctgggaaaggtctgtgtctgcgatgaaggcgaggccaggctgatgattctcttatgttcaggggaagacaccagggaggtggcaagaagcgccagggaggtgcagttttatttaagaaagcattatggactgtctctttccgttggaatcggtaagctggtgtcagaatggggagatttaaagctctcataccagaatgctgatgaagccctggaagagcggatgaagcagggcagcagccaggtcatcaccagggaagaatcccagggaaatcttcgcggggaaaagatattcatcacgtcagaggaagaggcagaattaaaaaatgctgtcacacttctggacaggcggaagatttatgatatgctggaagagatctttcaaaaatatgtcatggaacaggcggtgggacgaaaagccgtggaacagctttgtatgtacctggtgctgatggccatgcgggagatccagcgtttccagctgactcctgagcaggttctgggccgaaattactattattatgaagaaatatccaaatatgaaactgcggaagatttggaaatgtggctgaaggatatctatggctccgtgctccgggcggtggaagaacggcgaagcagcaaatacaaggggatcgtaacaaatggaattgcttatgcccaggaccatttttcagaaagcctgcaggtggcggaggtggcaaaggctgtttatgtgacgccaaactatttcagcaagatttttaaagaggagacaggagagaattttactgactggttaaacaagttccgcattgagatggcaaaaaagcggatggaaaaggagccggaaacaaaaatttataccattgcagaggaatgcggattcagcgattacaagtactttgcctttattttcaagaaatataccggatatacgcctacctcttaccggaacatgatcgtgtagaatatgaaaccttaatgtagaatatcaggtttatagattttccatggcttttataatggaagatattctataaaaaaaggatgaataaggaggacatcatggatcgatttttatttggggcagtctacattattgagcaggattatacacaggaggagatcaggagagatttggcttatatgaaagactgcggctttaacctggttactctctggccggtgtgcaatccatggcttgcacaggacagccatcagtggatattcactcagaccagacaggtgctcgatgagtgcgaaagcctgggaatgaaggctattttacagctctttggacagaatcaggctcaggaatttatgccggacagtgccttgaccgaggatatgctggtctgtgatgaaagaggagagcatatcaatgaaaattgcttctgggcgaacttaaatcatccggtggtccgggattatatggaccggtatttccgggaagcgatcacgtcattacgggatcacagggctgtatacggctacgacgtgtttaatgaagcccattttagaagcgacgacccttataccatacaaaagtatcaggaatggctggaggaaaaatacggcaccatcggacatttgaaccgggtgtggcatagaagatatgagagctttgggcagatttctcccaaaagaagaagatcgccttacagtatctggagcagcatcatgccggatctggaatatgaaaggttccggagcgtgactttgacccagatctgcagtttcctgtatgaaaccgcaaggaaatacgatacaagccatccgatcatcattgatggaaccagcgcacagatcctgtcaggggatgtgacccttcgcaacaacgatgaatttgccacggcaaagatcccggatgtgtacggctcaaccttttaccctaagagctggggaagaaattaccgcaatacgccctggactatgtccatgtattattctgttcccgcaggagcggcaaaaaaagccggaaaaccgtatatggtcaatgagttgcagactcacacccagtccgtgctgaccccaggctccgaggtaacaccccaggaattgtacaactggattcttatgtgtatcttcactggtgccaatgggatgcagctgtggcgctggaggccgttcttacacgggtaccagtccacgggacgggggcttaccagaatggatgggaccccaatgaacgtggggcacgggtgaaagagctgatgaacctgattcgggaaaatggagatttgtttgacagcttccaggtggaagctcctgctgtaaagatagctgtttcctattcttccagactttattttgatgcgtttttaaaatggaacaacagcttttggagtgaggatgtggaaggctggtaccgtcttttctggaacaggggcttaaatccggaatttacggatattgaggatctggaaggggaggaggccttgggtttggtgctgccttccgccttaagcatcagcggggacatggcagaaaagcttacctcatacgtagaacgaggaggaatcctcatctctgatggcagaatgggaagtgtcaatgaatacggggaagtgcctgcagaagggatcccgggaaagcatttaagcaggctcttcggactgcgggaagtggatgtggattccggtcactccttttccattaagaaaccaagtgacgtggaaaaaataaatcctttaaaagagagaattccatgtaatttcatggaacagcgtttagaggtggatgaggatacccggatccttggaaccatggaagacggaagtcctgccgtggtgcttcatccctatggaaagggctgcacactgtatttcaattcttttataggagcggagctgaaaaaacagaacatcccccaggtggagcagctggtgatggaggtgatcaccggacggcatgattctctgttcaccgtaaataagggaagcaaggtgcatgtggcctgcatccggtcagaggggagcagggcagttctgatcattaattttaatgaaaaggctgaagaagtgacgcttcatgggttgggaaataaaacagaatttgtgaatcttttaacaggtgaaattgtaaaggcccgggagcaggtaaagctgctgataccggagaatacggcttatatttataaatgtcagggggaatcagagtgaaattggtgtttgatgtaggcggaacagcggttaaatacggcgtttccgatgaggagggaaacttttctttcacagattcggtgcctacgccgaaaacagatgtgaaggaatttttgaaagtgaccggagatatattcgaaaaggctgtcagggaatatgcccttgacggtctggccttcagctttccgggagaggtgcacagcagggaaggggtaataaagggcatcagtgctgtagagtatctgcatcacatccctttgaagacgattctggaggaacggtttggcgggctccctgtgaccatggccaatgatgccaactgcgctgccatgggggaacgttggaaaggggtggcaaaggaatatcaaaatgttgtgtttgtgatctgcgggaccggtatcggggagcggtgatcgaacggggaatgctggacaagggagtgaccatgaaccggggagaattcgggaactttcccatgggaggctttcaggacggagcccttctttcctggagtgattataccctggaaaagcaggcacagaaatacaatatgaaaaaacagccaaaggaggctcctgttgatgggataaggctggaactgctgtccaggaagggagaccggctggctgaggaactgatggaagaattttactactggatggcggttggctgcataaccctggaatttgcctttgatccggaactcattgccctcggcggcgggatcagcagcaatccgggaatcattgaccggatccggaaaaaggtggtttccctgttggatggacaaaggcagggctatttaatgccaaggatcacagcctgcgcaaacggcagcagggcgaatctgtacggagctctttattatcacctgtatggagaaacgattgagttgaatggaattacagagcagaaccattgtggcctgatgctgagaaaagtaattgcacattaaaatgggatatgttaccatagtggcatggagcaatcgtgtcactgcaagggcgttggccttctatctttacatagataggaggtggtgcggatgaaatatgactttaaggaccttatgtcttttggtatgttcattttagcattacttacctttatattttataattgtaagtagcgtttttctataaagtcctgggaacaggcatagaaaaaccacccttgtatactttggacggttacagggtggaattttctatcgtttaatcggccaaccccttgtattggggtggttgctccttttgtgtatttattataacatttctggcatggcatttcaatagttttctttgatatgcaaagatcaaaaaacaacggacaggtatccgccattttgaatctcctaaattggaactataaatttattcagacgttgcaaacagaacatatatacgatttaaagcggtacaagtagccttaaaaacaatgatttcatgacacatcaatgtatcaaaacgtgaatttgaataggagagatgaagatggattatgtatttccaaagggatttttatggggaggagcatcttccggtccccagtcagaaggcggaagcagcgaaggcggacgtgtaaaatcggaatgggattactggtttgaaagggaaccggaacggttttttgacggagtaggaccggcagtgacatccgatttttatcacaaatatgaagaatacatcaggaagatgaggctggccggtgtgacttcctaccggacctccattcaatggagcagggtgattaaggactgtgaaggaactgtaaacgaagagggagtgaaattctatgatgatgtgatcaatgaaatgattgcaaacggaatagaacccatgatgtgccttcatcattttgacttgccggagtattgggtgaaaaaaggcggatttgagaacagggaaaccgtttttgcatttgcaaaatttgctgctgtttgctttgagcggtttggggaccgggtaacatactggactaccttcaacgaaccggtcatcattccggaaacagggtacttatatcagagacattatcctgcagtatgtgacgcaaagaaagcggctaatgtgggatatcatgttcagctggccagcagccttgcagtggaagaattccgtaaaagcgtctgcaggggtaaaataggcattatcatcaacttaacgccaacctattgtgaaaatccagaaagggaagaagaccggaaggctgcggatattctggatctgatctttaaccgttccttcctggatccatcggtgaaaggtgaatatccggaggcattgacaaagctgctgaaggaggaggggattcttccccaggtgatggaaggggatctggatataatccgtaaaaatacagtggattatctgggcgtaaattattatcatccaaggcgggccaaagccaggactaccccttatgagggaccgctgatgccggaaaaatattatgagccttatacctttccagggcagaagatgaacacttccagaggctgggagatttatgagccggccatttatgatattgcaaaaaatattaaggagaactacggaaatcttccatggtacatatcagaaaacggaatgggaattcagggagaagaggagttcttagatgagaacggtgtggtggcagatgattaccggatcgaattcatcaaggggcatttgaaatacttacataaagccatagaggaaggttgtaattgctttggatatcatttatgggcgccctttgactgctggtcctggatcaatgcctataagaaccggtacggcctgttaagggtggatatttatgataactgcaagatcaccatgaagaaatcgggcacctggtttaaggagctgtcagaccggaatggcttttaaccgattgatcaggaaaattgcggagggaaatcatggaaataagaaaagactgccccattcgcctgacaggctccagggcctggcggacctattttgggggtaaactattggaacaatttcacggggaaaagaatggggaagatgatcatttcccggaagaatggattgcctctcttgtggcagccaggaacgccggaagggaagaattgacagaaggcttaagcatgctggcagaccggccgtcagtgtccttgaaagagctgattgaatcagatcctgccggttatctgggagaggagcatgccgcacagctgggagcaaccctgggggtgctggtgaagctgattgattcggcagagcggctggccgttcaggtgcatccggataaaaagaaggccagagaactgtttcattccgaatacgggaaaacagaatgctggcacatactgggcggcagggagattcatggagaaaaaccttatgtttaccttggatttcgtcccggtgtgacacgggagcattggaaggactgcttcctgcgtcaggatatagaagccatacttcagtgtcttcaccggtttgaagtacaggagggggataccattctgattgaaggcggtgttcctcatgcaattggtgccggctgttttctggtggaaatccaggagccgactgattataccatacgggtggagcgtgtgaccccgtcagggtatcaggtggctgattccatgtgccaccagggactgggttttgagaaaatgtttgaatgcttccattatgaaaatttttcagaggaggaggccaggaaacggtggttcattccggcaaagcttttaaaagaagagggaaaaaaccgccggatccgtctggtgggatatgaagacaccccatgtttttccatggaaatgctggaagtaaaagacgtcatgagcatgaaacagaatggctgcagcgcagcttatgtactggagggcaggggaaaactgcttttaggaggaaaaaatgccgggcaggagaacggctggcaggaggagatcagtcagggggaccagttttttctgccaacgggaactgaggaacttcagtggctggctgaagaaggaagccatttaaagcttatccagtgttttgggcctgaaataaaataaaatggaaatccgtccccacctttgcttaagaggggagaaagaggggaagataagaacaggacgtattttgggagtaatgggatgaatcttatctttcttatcatggcctggctgccaatcctggttggagccttggggatcgttttgattttttattatttttatcagtggatgaagggtttccggctgattaaataccggctggctggtgaaatctgccttttggccgtacttgcgtattttttggtgttttttatttttggatttctgggccttggcctggcttccggttaacaggggcaggccgggccttttcttataatttgtgaaaattgtaaaattcctttaattcttccttcctcttctgaggcaggaggctttttttaatcccctgtatggctccttccaggccatagagacggtggatgcaggcggaggagtccatggcctggatcttcagccaagcctgttctgtgcctgtttcctttaattcttcataagtaaagattccggtttcatttaactgccgttccacttcttttccaatattcggaagctttgataattctcccatatgaatcctcctttttatagctgtcttttattataatagctcttatggaaaagggagtaaaggatatccctgaaaatgttcatgagtttttggaactgtttcggtgttttctgggggtgatatgaaattctcttttaaacaggcggtcaaaatagctggtgctttcaaatccggtatgctccgcaatgtcggtaatggaacggtccgtgtgaagaagcagcttccaggcctgatggagccggtatttatttaagtattccataggggataaagggaccgagcaatgaaagcagcggagggcttcccgtttacttacgcccactgatgcggcgatgtcctccagggtgattttttttcggtagttttcctcaataaaacaggtcatgcccttaaaacgggcctgagagatcctggttattcccgtattctccatggtgggaaattcctgtctgtgttcaaacaggctttgccagacctggcagaccagggtatgggcttccagctcccaggccggtccgggatgttcacataagtaatacagccttataagagagaagagaacgtctttctgccagggagtgttactcttcagcacaaagtgggaaatgcctgaggtgagaaagggaaggaggtatttttcgtgaatggagctgctttccggtgcaatgaaatcagatgcaaacaaaacgtttgggatgaccgctgttccggctgagagaaagcggtgaatgacgccggaattgatgaatatcccatctccggcttccagtatgtgattgatgtttcccacggagcactggaggatcccttctgttacggataccagctcaaattccttatgccagtgccagtcaatgcattggttatcaaattttcctacatcctcgtaataatattgaaagggaaacgtggaggaaccgtgggggacaagctccatcatggattcgtcggtgagtattttcgtgctttgcatagagcattctcctttgcttgattggctagattgtatcataaactggcggtaatttacaagaatttcaaaaaaatatgcggtataatacaaaaaataaacagcaggtgattacaatgaataaagattataccaaaaccgtccatgcctgttttttgagctatatcgtacaggcgatcattaacaattttgttccccttttgtttctgacattccagtccgagtatggcatttccttatccaggatcaccatgcttgtgacccttaattttggaatccagctgttggtggatttattgtcagcaggtgtgattgaccgggtaggataccgtgcttccatgataacggcacacgtattgtcggcaatcggactgatctctctgactgttctgccgggattgttttcccaggcatggatgggcctttttatctcagtggccatctatgcggcaggaggcggacttttggaggttcttgtaagtcctattgtggaagcctgtcccacagacaacaaggaaaaagccatgagcatgcttcattccttttattgctggggccatgttgccgttgtccttgtatccaccatatttttcgccgttgccggattgaagagctggaggcttttggcgcttttttgggccctggttcccgttgtcaacatgatcctgttttttaaggtgcccattgctcctcttgtggaagaggatgaaggtctttccttaaaggcccttattggaaaacggatattctggggattcatgcttctcatgatatgtgccggggccagtgagcaggcggtaagccagtgggcgtctgcatttgcggagaaagggctgggagtgagcaaggccgtaggagatctcacgggtcccatgttttttgccgtaatgatgggaacctcaagggctgtttatggaaaatacggggaaaaggtaaatttgaaaaagacgatgattgcaagcgggattctttgcataggctcttattttctgatttccctttcgccttttccggctttgggccttttgggctgcgggctgtgcggcttatccgtgggcatcatgtggccgggagcctttagcatggcctctgcttctttgcggggggaggaaccgcaatgtttgcatttctggcgctggcaggcgatttgggctgttccggggaccttcctttgtaggcattgtttccgggtattttggggataatttaaaaattggaatattaggagctgtcctgtttcccgttattctggtattcatcctgatccgcttttataaatcaggcaaagagacagaaattcttatgaaaaataatggagagcagatgaattgtgacatatagatgtcatgttccatatgctacaatcggcttaccatatgaagaaaagaggtaagcagaatggattttgagaaggtttttctaaaggaaaaaaaggcagtggggctgatggcccggacaaacaatggatcaccggacatgggaaatgtgatcgggggcatgtgggagagcttttacggcagggggtttattctgccattaaaaataagagcaataacaaggctctgggaatttatacggattatgacggggcggaaatggatgattacagcgtaataacagcctgtgaagtagaagctgcagatgacattcccgaaggcacggtggcaaggaccattccggatgggacgtatgccaagtttgtggtaagaggaaacatggtaaaggcggtagcagaattctggcaggagctttggaagctggatctgccaagagcctttgtctgtgattttgaggaatatcagaacgaagacatggaggatgcggttatccatatttatatcggtttaaaggattgatgaacaaaaaggagggagccgtctgcggcttcctcctttttgttattaatagatgacttcttcaaatccttctgtggaaggaaattcaatggaaacggcttttcccggatccttataatttaagtttatattcatgaccaggtccatggtttcttcgtcttcggttatcgttgtgtatatggaaatgacttccctggaaaagtagccttccgggctgatgaatgcctttccgtcaatccggttgatcttataatcagaatcagaaagggaaggccatatcccgtcataaacattggtgagatatttttctaagccttctgtcttgctggagtacatgaggatcttattccctccttctccgtctgcaatctgtacattatcaaggaatgccccaaactgcccggtcaagcctcccagggtgaggtttctggtcatatcctcatgtccgattttcatcttgtatttatcatactctcccatgtcggaataatagcagccgttggtgtagaaggaagtttctgatttacgtattcccatcatatcaatatcggtctgggaaagaaattccataccaggagtgtttaagtcatgatattttagctgcatgttcatggtgataggtatctccagccagtcatagtaaaaattcatcccgatatctgcggagatatccagacccggcagtccggagcttttttggtctgcttcctggtaaagctccagccctttccggttcatgttccgtgaggcagacggggatgaggccctttgacggacaacgccctcatcggtccatgcaccggattcattgacaatgctgccgtcaggggcagtggttccggtcaaaagatagccgttttcatcgaaatagtagcattctgccatgccatccccatcggaatcgatccatttccatgtggaggaggggtaggatttatcgctgtcctgccaccaccagccatggccgtcctgcttccaggctcccgcatgggcggttaatgccatggatacggacagaagggctgcgactgcaaataattttatgatttttttcatgaagttttcattcctcctgtttgttttgttcaccctgaaagggagaaaagaaccggacaatgtttcccatgcctgtacttattcatccactataccatattttggtaattacagcaagaatatgacacaccatgtatccgataagtgttttgatgtacccaatgccagttgatgagcagaatcaggcatgttaaaatatgtggtaaatgggaaaaaaaggagaaaagtaatatgtacggactgacaagtaatctggtaaacatactgttttttgtggcagcaggtattgcaattgccacggctatcataaaaaagagaaagaagtaacagtggatagccggtattaccgggtaatgagatgactaatgaataataactagaaaagatatatggaggaattgagtgtgtatagtgatttgtatgcttctttagctgtatttggtatttttcttttagtatttggtttaggtgcttgtattttctttattgttaccaattggagaattttttcaaaagccggcaagccaggctgggcggctttgataccaatttacaatatttatatttcgtctgatattgcttttggaaatataagctattttgttgcggtaatgatcttatgggtagtttctatgatcggaggatttgcagaagttggatttttaagcagtcttgcagggctggcttccctggttttatatattatctactgtgtcaagatttccaaggcttttggaaagggcggcgggtttgcagttggcttagtgctgctgccgttaatatttttcccaattctggcattcggcagtgccgagtacataggaccgcaaaataattaaggtttccaggcggtgtcctttttttatcatatgaggcagcaaagcggattgcgaatatccgctggaccatgaaataacctgacaagagaggcggttgatcccctctctttttttgtaattggaaaattctttggcccctttttcccctgccttctgttggattccttaagtatcaatgattcctcacacataggtacttgattattttggaaaaattcagtacactaaattcgaaacggaacatgttgctttgtattaagactgaaaaaagttcaaaatatctgtttccgttatgttatgccttatgattttaccgatcgtatcactgcatatcgtgcaaaagtaatcacctgcctggtagctgcagtaatccaccggaagcatccgtgtattaataaggctgggatcttggataaaaccggtgccggtcttttttagataagcttcttttttgtccatatctcataaaacttatgcacgtttgtatttattgaagcggactcaatgtaagatatctcatccggatggaagactgtttccataatttcaaatggaggggattaagtttttcaatatctgcccccaccggctgatgatcggatatacaaagtaaaatacaactccgggtatgagataaattaaagtacaaattttctgtgtttgccaaataaggctttcccattgcttcataagctatttccagtttatctgcgggaactcccattcgtctgctcacgaccatccgcgtcagcagcgctgcatacagagacagcaggcggtcggaaaaaaaacggtaccttagtattttttcttttctttcgttcgggacaaattgcagtaaatgtttttcctcatgggaaaatacagatttgttaacttctaaatgataattctcaatcatggaatcctcccaaggaaaatcatgtttttatgttatatcgtatcatttcaggacaatttgtcaaattattttttaaatttaagaataaaaattaaagggtattctgtaagcaaaatggggccctgaaaggaaatgaaatttggaggcagccaatgagaccaacgaatgaaaaattaaaacaagccattttggatgcagggaagcaggaattcttaacccaggggtaccaaaaagcatccatgcggaacatcgcaagatcggcagggccacaaccggtgctgtttatatttattttactgataaacaggcactgtttcacgcactcgtatcagaggctgctgagcagcttgagaatcggtacagagatcagcagcaggagttttgggatctggatgtggatcatcagatcgaaaacctggaccagcttgcgaaacatgaccagaattggttaattgaatatgtttatgaccactttgaagagtttaaattgatttgctgttgttccgcaggaacggtttatgagaattatatggatcagctggttcaaattgaagcagaagccagcctgacttttattgagcggcttcaatcggaaagaggaaagcagttaaggatcgataaagagctggttcatattgtctccaatgctttgttttctggtattttcgaaaccgtaattcacgatatgccgcgggaaaaagccagagaatatattgagcggctgtatgttttttatgaagccgggtggtttaagcttctggatatagaattataatcagagcaatgcatcctgattcccggtgaggaacgtaatattttatgatctgcattccagagaatagaatattacgttcctttttgctatcatatagaagatagaaagacatccttttacatgtaatttccatacctgccataatttaccttgacaaaagccataattggaattaaaatatcagtgttatctaaagagtttaaagttcggagtatctgactgctccgctttttaacaccctaaggttagttgtatctaactgcatgttttatgataaatatctcattgcatgcctaataggggaaagagataggaaggagtcttttttatggaggattacgaaaaacaatcttcagccagtattttgatggaatggggaaaaaaatatcaatcacagttcattctgtcaattttttttgcagtgatcggagtcgcaggaggaattgtcccatatttttgtgcggctcaaatggtaggcgggctgttggaagggaatgatgactttcatttttatgttacatggtgcgggacagcgctggcaggatatctggtaaaaatcatattttcctgtacttccacgtccatatcccataaagccacatacagatcgctgaaggatctgcggatccgtttaattaaaaaactgacacggcttcccatgggaaccatattggacaccccttccgggcagtataaaacggtcatagtagagcgggtggaaggcatggaacccacattggcccatctgattccggagatgaccgcgaacctattgattcccatttttattttcatttatctttttatattagattggaggatggcatttatctcaatcatcacactgattgtgggaatggctgttatgatgtatgggatgagaggatatgccaagcggtatgaaggggcggtccttgcaggccggaaaatggtaaatgccattatcgaatacatcaacggaatagaagtgatcaagacctttaaccagtcagccggatcctataaaaagtatgctgatgccgtatcctataacggaaattactatattgactggatgagagataatcagaaaacaatgtgtgcatatcaggccatacttccggccaatttactgacggtgctgccggccggattgtatttctgggccacaggaagtattgctttccatgaactgctgacgatcatcatcttagctctgggcattatcgggcccattatggctgccttcacatttacagatgatattgcggtgcttggtgccaatgttgcagaaattaacgatattttaaatgccggggaactgaaccgttcagaaactgatgcaatattggacggaagtgatattcagttaaacaatgtatcttttacatatggaacgggcaatgaacaggctcttgatcatgtcagcttaaggattcctgcagggacaatgacggcactggtaggcccctctggttccggaaaatccactctggccaaattgattgccggcttttgggatgtaacagaaggtgaaattcatatcggcggtgttgagatgaaacagattcctgtgtcgcagcttaattgtcagattgcttacgtttcacaggatacgtatttatttaaccgcagcatccgtgagaatatccggatgggcaatttgaatgcatcggatgaagaggtggaagaagtggcaaaacgagccggctgtgatgaatttatccggaaactggaacatggctatgataccctggttggaacggccggaagcagtttgtccggcggcgagcggcaaagaatcaccattgccagagcaatgcttaaaaatgccccgattgtaattttagatgaagctacggcagcaatggatccggaaaatgaagctgaaattcaaagagcactttcttccctgaccaaaggaaagacattgatcataattgcccatcgtttatccacaattgttgatgcggatcagattgttgtggtaaaccatggcaggattgaagcggcgggcaggcaggatgagctgcttcttcagtgccctctgtatcaggaaatgtggaatgcacatatggatgtcaaggatcaggcgtagaggagggaatgaaatgatacatatttttcggaagatctttacctttgccggagagcggaaaaagatgctggttcagtcaatctggattagttttatgggatctgtttttgcggcgcttcagttttgggcattgctgattttgattcagaatgttctggctgataaccgtgagctaaaaaccgccgcatatctttttgggattatgctggtgtcgattgccggaaaagcctgggcgacttatggatcggtaatcaaacagactgaaaccggatatggtatggtcattgataaaagagtgcatatcggggatcggttaaaatacattcctatgggattttttaatgaaaataatcttggcaatctaactgcagttgtaacgacttctcttggagatgtggaaaacacggcggcccgaagtctggctatcatactgagcggcatcttacagtctctggctttttccatcgctgtactgatcattgatttcagaatcggcctggtggtttttgggggaatgattatttatctgatcattacggaagtggctcagcgccgctcccgcattgtctccgggaaacggcagactgcacaggaagaactggtgggtgcgattttggaatatgtgcaggggatgagcgtggtgaaatcgtttaatctggaagctgccggaaatcaggaaattgatgatgccatacataaaagctgtgaaaaaaacattaacctgactttaaaaagtgttccctgggatgggttaaagcagctgattgtaagggctgccggtacaggaatcctgttgatgactgtccgtctgtatctggatggaggactggagcttgtaaagtgcctgctgctgatcattgcttcctttatggtttacagtgaactggaatcagcgggtaatatggcttccatgcttcagatgctgaatgattcgatggataaggcaaatgccattgatgagacccccgttatggaccagaacggaatggagatcgttccggagaatatggaaatcaaatttcaggatgttgacttttgttatgaaaaaagtgagagaaaggtgctggaaaaaatcaacctggttattcccgaaaagtcaactgtggcagtgatcggacccagcggcggcggaaaatccacactttgcagtttgatcgcaaggttttgggatgtgaccggcggccggatccttttaggaggaaccgatatcagaaactatacgctggacagtcttttagagcatatcagtatggtgttccagagcgtgtatctgtttcaggataccatcgaaaataacattaaattcggcagaccggaagccacacatgaagaggtggtaaaggctgctaaggctgcctgctgcgatgagtttatccgccagctgccggaaggttatcatacggtgctgggagagggtgggggcaatctttccggaggagaaaaacagcggatttccattgccagggcaatgcttaaaaatgccccgattgtaattctcgatgaggcgacagccaatgtggaccctgagaatgaagcggatttacagaaggccattgaggcattaactcacaataaaaccattatcatgatcgctcaccggttaaaaacagtgagaaatgcagatcattgttttggatcaagggaatatcgtacagaaaggcagacatgaggagctgatcaaacagccgggaatttacgcagattttattaacgtcagaaaagaatcagtcagctggaaggtgagccaatgaacggaactgcagcagggtatgagaaaacatttccctttgagagtaagctgatccttaacccgggagcgggaaatgagaaaagggtaatgaatgtattttgtttccaccatgcaggcggaaccgcagcatcttaccggaaatggaccacaaaattaatgccggtcagaatcatctgcgtggagctgatgggaaaaggaacaaggcgcggggaaccgtttattgggaacagcaaaatgctggcacagactttggcacagcagatactggctaaaacaggaagtgaacctttttgcctgtttggccacagcatgggggcggctctggcatttgaagtctgctgcatcctggaacggttatatggggtgaggccggaaaagctgatcgtggcaggccgtcaggctccccaggatgagaacttttccgagttcaagacttatatggatgatcaggccctgattgaggaattgaggcgttatcagctcaccccggaggctgtgctgcagaatgagcagtttatgagctattaccttcctgaaatcagaagagattatcaattgaatgagagcttttgctacaacggcgaaaggactgatgttccggtgattgcccattcggccataaaagatgcaggagcagacaaaaaaatgatgaagcgttggaaagaagtaactacaaatcattttgagattcgcgagttcaaaggaaaccacttttttgtgttggaggacgaaagctatcttgccggtttagtagaagatgtgatgaagtaaaatggccaaaggaggataatgataaaatgagcagagaaagcagcagtaaattgagtatgaaagatataataatagcatctgttttgggggtgatttgcattgcgatccgctttctttttatgatcttaggagggattctgcctgttgcatggtttgcatcccatatgtttgatgcgattttcattggtccggtttatatgctgattgtagcaaaaaccaggagaacaggacctgtttttgtgatcagtctggttactggaattatatttatttcagcagcaatttcgatcatcgtttcagaaatcattgccggtattttagctgaactggcgctcagaaaagggcagtttgaaaataagttctggatcatgatctcttatgttatcttttcttttggatttattggagatttttatctgttgtggttccacaaagagtcctttttgaaatattcggaaaattttatgaatgccgaatatctggatgcgttaagccggctggtctccgcaccgacaatgatctttattatcgtcagcattctgattggttctttagcaggtgggtttttaggttttaaactgatgagaaaacactttgtaaaggcaggagttgctcagtaatgtatggaaaaagcaggggattggatccccggatcggcatgatactgatcattttatcagtggttattgtattttcccatacaaagttatacatagaatggatttttatgtccagcattttatttttaatgtattgtttcggagtcagaaaaaccatgtttcagattttggccagttatctggtcttatgtgtcattcaggttttcgtaattcctaatgtaaatgtcacattggccagcatgatatcggtagctgtttattttaaaatgatttttccgtgtggtgcggccgtagctttgttttgcgcaacaacaccggtccgggttttgctggaggctttccgaagaatgcatattccattatctgtttcagtggcggtagcggtgtccgccagatattttcccacgctgaaggatgaactgacggcaatttggaatgccatgcgtctgcgtaatataaagggaatggaacagaaaatagagagtatgtatgtaccgcttttaatgagtgcggtaaagaccggtgaagaactggcacaatcggccattgtccggggaatagaaaatccagctcccaagacttccattgtcgagatccggatccggttattggatgtactggtgctggtgtatttcctgctgctggcaggggcagccatttggctggggtaaaaaatcattgggaggcaaaatgattcgtatttgtgatgtgacatttacatatgaaggagaagaaaaggccagcttgctccattgcagtatggaggtgaaacggggagagtttgttatgctctgcgggaaaagcggatgcggaaaaacaacgctaataaagctgatcaatggactgattccggaacagattccagggactttaagcggctcggtgtggattaacaatgaaaatacagccgaccagccgacctggaaactgtctgaaacggtaggctctgtttttcaaaatccaagaacgcaattttttaatttggataccaccagcgaggttgtatacggactggaaaataagggggttcccaaagatgacattttggggcgcttgcagcaggttgtggcggaatatcatctgcacacactgatggagaaaagtgtctttgaattgtcaggaggagaaaagcagaaggttgctattgcttccgcatatatggaacaaccggagatttatgtgcttgacgaaccttccgctaatttggatcaggaagaaatactgcggctgcagggattgttaaaacaattaaaaaagcaggggaaaaccattgtgattgcggaacacagggtctggtatctggcggatctgctggaccgggcgctttggctggaagagggggccgttgcaaaagagtggagtcaggaggaatttaaggctctgactcctgaacaatgccgggagtggtcgatccgttcggttgatccggtggaaattcatgaggaacgggttcaaatccagagcagtgagggcctgatggtgaaaaatctggcggttaaaagaggacgccgtattctatgggaacacctttcctttactgcattgaaaggaaccgtggtagccatttgcggcaaaaacggagcaggaaaaacgactctggtccagtgtttgtgcggacttaggaagtgtaagcaggggagctgtatctggatggcaggcggatgaaccggaaacagctttgcaaaagcagttttttgattatgcaggatgtcaatcaccagcttttttccgacagtgtgctgtcagaggttatgcttggaaatggtgcttctgaaaaagaggccatagagattcttgacaccatggaactgagcggttttttagaaaagcatcccatggctttatcaggcgggcagaaacagcgtctggcagttgctacgggatgtttaagtgaaaaagagattattattttcgatgaaccaaccagcggtttggacctggataatatgaaacgggtcggcgatttaatcaatatgttgtgtgaaaagaataaaattgtcattgtcattactcatgatttggaatttatcaatcatttaagagcatcagtggttacaatcggctaagccggttgataatcatacccatgagttagtcatgactaactaaatgcaacggcaagggggaaattatgatcggtgtcattggagggtacgggaatattggccgtgaggtgattcaattgctgacaaaacggggatatgaaaggatcacggtcggcagccgcaggcagaatccagaaaatccaattttatggagctatgtgaatattgaagaagaggagagccttcttcattttatgaaccggcatttcattgtgataaacacagccgggccatcgtctttattgtcattgaaagcagcagaatgcgctttaaaatccggctgccattacattgactgcggttacaaccgtgaagtgaccaggctttcggtgaaggataaggcccagtgtatgttatacaatatgggttcagtaccgggattctcagaacttttacctcttgtttttcaggaagatttattaaggccccagaggtttaggcatttctacagcatcaccggtaaatttactcagacggctgcaattgattttatggctgggatttttaacgggaatggaggagtgtccctgcggacagacggaaaaattccagaaataagtgaacttcagccgttttacaaaaacgcagaacgcatgataccttacgaaaacgctgatacagctcgtgttcaggagatgatgaacggagtggaggcgcaatggtttcacgtgatttgcggcagtaatatcaatgctttttacaaaaatttattaaaaaagtatgttcaggacagagaaaagctggctgccgatctttgtctggctgctgaacttgatcatatgctccttccttctcaggtgacgttcttacttgaaatggaggggatcaaccgggagggaaaaccacagaaaaacttatattatcttcaggccccagggcaaagcaagctatcggcagccttttgtacggcggtctgtgaatgtcttttagaaggctgtattgaaccgggaatcggctggattgaaaagcttacagatccggcggctgtgtttgaaaaagtgaagcagtttggtcttgtaagtctgaaaaagacagtgcatggagcattggaggaaaaggaagaaggagttttgtaacgtgcaaaggagaacttatggaaatgattttacagaatttatctgagatggaaaaccgggggattcgtctgaatgaacaggatggaaacataaaataccatgctccgaaagggacgttaacaccggaagatattcagtttttaaaaaaccataaacctgaaatcataaaaatcttaaaacaccgggaagggaaggcagttctttccattgatccggagcagcaatatgagccatttccccttaccggtatccaggaggcgtatttattaggaagaaacaatacgtatcaatacggaggggtatcctgtcacatctatatggaaatagaatatccttccctggatccggaccgggtggaagtggtatggaatcaactgattgacaggcatgggatgttaaaaacggtgttcactcaggaaggatatcagcaggagctgccggaagttccgtattttaaaatcaccagagcagccggagagcaggagagtctggatctacgcagccaattagaccataagatgtatccggttgatcgctggccgctgtttgacatcggtgtgtcagatttaggcggctgcagcattcttcattattcaacagagtttctgatcgtggactggacaagtatatggatgctgctgtcagaatttgaagccatctatttcagacagcagcagatgcccgtgctgaagctgcgtttccgggattatgtattagcggaaaggcagttgaaacataccctgaaatataaaagggatcagcagtactggctggaaagaataccggatataaaagcagctcccaagcttccccaggatcacggcaaacagttacaaaacacattccgccggctgcagatggaaattccaccggaatactgggaacagatcaagaaaaaatgtaaatcagccggcgtcacccctaccagttatgtgctggccgcatatgcaaaagtgcttgccaggtacagtgagacagatgaatttaccataaatatgatcatgctgaatcgccagccccttcatgaagaagtcaatcagatcatcggagattttacgtcgaatacactgattccggttattatgagggagggccggccatttcttaatgaggttctggagatcaatcaggctgtttttgaagccctggatcatggcttgttctccggtgtggaaattctccgggaactgtcgcgtcaaaaaggcagggatgcagcgcttatgccgattatttttaccagtgccataggcattaccagccagaatgatgaaattgcaggaaaaataagaaataccggaatcagccagacaccccaggcctttgttgactgccaggcaatggatggcatctttggcctgagaatcaactgggatgtgagagagggtattttttatgatgggtatctggaagatatgtttcagacatttgaaacagttatactggaggctgcctctcctgaaaccaactggacgaaggagttctcctttgctttgcctgagtggcagcagctggaaagagacgcagccaaccggactgccggaccagtggggaatagaacccttcatcagctggtgctggaccaggcccaaaggacaccggacctgctggctgcggcagattgtgaacatcggttcagctattgccggctgatagaaaagagtaagcaattggcttttgccataaaggaatttggtttggcagaaggagcccatatgggaattataatgcccaaaaatgtttaccagattgttgccgctttaggtacgctgctgtgcggcggggtatttgttcctatcgatgacagcgaagcctttgaacggacggaaacgattatcaaaaatgctgatatcaagctgctgctggtgcatagccgtaccaggtatcaaacggatcatttaaacgtgatcgtagtagatcagctggaacaaaccgggaaacaggaaacagaagtccaggttcatgacggacttccggcttacatcatttatacttccggctcaacgggaattcccaaaggagtggtcatcagtcacaaggccgcagtgaacaccatctgtgatgtgaacggacgtttcggaatccgggaaggagaccgggtgctggggctgtcacagctgaattttgatttgtcggtttatgatatttttggaatgctgagtgttggaggcggggtgatctaccctgaccatgataaatattcggacccatcccactgggtaaagttaatagaaaaataccggatttcggtctggaactcggttccttctctgttggtaatgctgcaggaatatttgcagactcaaaaggagcagcagctggattccatgagagttgttttgctgtccggagactggattcccatcaagcttcctcagaagatacagccatttttgccgtcagctgaaattgtcagtctgggcggtgctaccgaagccgcaatctggtccatttatcatgtatatcggggattgaaaacggattgggtaagcattccatatggaaagccgctggctaatcagcagatccatatattaaataaaaaactggaagaaagtccggtatggttaaaaggagacttatacatttccggagagggattggccatgggatattatggtgataaagacagaaccggggaacagttctttttcgtcccctccctgggcaggagagtttaccgcaccggtgatatgggaagatatatgccgggcggagaaattgaatttctgggcagggaggacaagcagattaaaatcctgggctttcggattgaactgggggagattgagtcggccttaaagcggtttccgggtgtggaaggtgcaatggcagtaaccatggcggttaacaatatgacaaaaatcatgggaataacatggggaggagagaacccatttaaagaggcggaaataaaagattttttaaaggacaagattccatcttacatgattccctatcgtatgatccatgtggaacatgtgccattaaccccaaatggaaaaacagacagaagagcactggaaagcctggttcgctcccaaatggaggcagcttcaaccgggccggagcaggagcttataatttcctcctgcggctgtctggaaaaaataaaaagtacggtttgccgggttatggaattaccggatatcggcatacatgaggatctttatgaaataggagcggattctctgattatgaatcgtcttgctgcaagcttaacggaagccttttcccaatattatgattttgaagagattctcatccagctattgaatgatcctaccattgaggctttcagccagtttatagagagaagtgagggaaaagtcagttgagtaaatggatagcacatgaagtacggcaccgggatgggggtatcaatttcatcagttttccctatgcaggcggaagtcccagtatgtttgctccctggaaaagtgaaattccggagactattaatttttttcctgttctctatcccggaagggaattgcggaaaagtgatcccatgccaaagactgtggacttgtttgccaaacagtttgtggatgaaaaccaggaattatttcaaaatgattttattctgttcggtcattgcaccggcactttgcttgcctatgaggtactgttggaggtgcggcggcgatttgggaaagagcctttgtatctcctggcttccggttcagaatcaccacggtttttaatgacaagggaacgtgaaatggaaaagcggggcgcctctgatgaagaaatgattgacatgatggtggaatatgagctggttgatccggatacggcacgcagcgttctgtttcaaaagtattatctgccgatttaccggatggatcttaacatgctttcaacgtatcggtttaccagccatgagaaattacattgccccatccgggtgatgtatggaaaggacgaccgtaccttgcgaaaggaagcggttcaggattgggaagcattttctgacgatccggttgaatttaagctgtttcaaggaaaacatttttattttgcagaagacaaaatgccgctccttggatatgtaaaagagttgattgaaccattcacatgaaaagaaagaggggactcctgttatgatgaaaataacatacgatattgaacaaattaccttccatgaaaagctggcggaattgtctgccagatatcaggataagactgcaatgattgacggtgatatgcagtttacatatttagatatgctgaactattctgataatctggcttccggatatctggaaatgggtattaaaaaaggcgaccatgtgctgctgcagctgccaaatacagccggatttgtttttaccatatttgcgctggccaagattggggccataccgattatggggcttccgtcactgcgggaagctgacttaaaacatatgattcagttcacccagcccactgcttatattgccgcggaacattatcttggctacgattatgggcagctggcagacaggctgcagcaggagtatccgtgcattaaatatgtggtgcttgattctgagaaaagcgggaagcagacgattcagcagttttaccgtaaaaaggcagatcctgctgacgaggcggcagtacctggggatcttgcatttttattgctttccggtggaaccaccaatacgcctaagttaattcccagaacccaggctgattatttatataatgcgaaaaagtcagccaaacggtgccggatggatgaacagaccgtatacttagcggcactgcctgttgcccacaattttgccctgggaaatgccggcattatgggaacctttttgtcaggcggaacggccgttcttgcaaagaccagcagtcccgatgagcttctgatgctgattgcacaggagcgggttactcataccggtatggtccccgcggtagtaaaccttttgatggacatgctggagtggtgggatgagggagacttatccagctggaaagtactgcaggtgggcggttctgtattggaacagagcattgccaaaagaatttttgaacggcttccctgtaagctgcagcagacctttggaatagcggaaggcattactgcaatgaccagtctggatgacagcgatgagatcatcttatccactcaggggacattggtttctgagctggatgaaatcaagattgcagatgaacagggaaactgtgtgccccagggtgaatatggagaactgcttgccagaggtccttataccattcatggttattatggttctgaagaggcaaatgcacggagctttacagcggatgggtattaccgcaccggtgacaaggcaatgatcacttcccagggaaatcttgtggtttccggaaggattacagagcagatcaaccgtgccggtgaaaaaatcatgcccatagaactggaaaactgcctgtgtgagcatccgttgattaaggaagccagcgtggtgggagttcctgatgagatgtatggccatcaggcatgtgcgtttattattactgaggaggacgatctggatcttttaacagtcaacagctttttaaaggagaccggactggcagattataaacgtcttgacagtctgtacatactggaagcgtttccccttaccaatgtgggaaaggtaaataagaaaaaactgacagaaatggccattgccaataagatcaattaaaggagcaggcgtccttttgactgcggtcagcgggcggaagaggagatgaaaaagtgtttgaatatcaggatattaagatacagatcggaaagatactgaaggtaaacccggaaaatatacatgatcaggacaatctgattgaaatgggaattaattctttgaaaatcatgagactggttaatgactggaggaaacgaggtgcaaaggtaacttttgcagaattgatttcacagcctacgtttcaggactggtggatcctcctttccatatataatcaaagcgaatctgcgcccggggaaacgaagctggcattgccgaaagacgatacaaaaaaacagtttgatttaacggatgtacagtatgcctactgggtcgggcgaaaaaagggacaggttctgggggataccggctgccatgcctatattgaagtagccggtgagaacattgatgcaaaacagctgcaacaagcctggaaacagcttatcatgcaccatcccgcactgcggacccgttttacggaagacggaaaacaggaggtattaacagcttctccttatgaagaggtcatgttatgtgatatgcgcagcaggaccccggaggaagtggaacgtggattaaatcagctgcgtcaggcattgtcccatcggaaattatccgtagaaacaggggagaatgccggattgacattaacgctcctgcctgaggggaaagccaggattcactttgatgtggacttactggcagcagatgtacagagtttccagatcatactccgtgatcttgccagactgtaccgcagcgagaacctgtctgtaagcaaggactggaatttcggggcatatttggaagcagtacatcagcaggctgccggggcacaaaaagaggcggaagcattttggcaggagaaaatacccacacttcccctgggtccggagcttccgctgaaaaaagcgccggaaacaatagaaaaaacagtatttgctcctcacaaggccgggttcactccggaacaatgggaaaccatcaggaaaaaggccgctcagtaccagatcactccggcaatggtatttttgacaatttattgtgagatccttgaacggtggagtgaaaaatcccgttttctggtcaacctcccgctgtttaaccggcacacggagtttgacgggattgaagatgtggtggcggatttttccaatattttattattggatgttgactgcagcgattccagaacctttgtggaacgtgccaggcagcttcagcagcgctttcacaatgatataaaatattctgcctattccggtgttcaggtgacaagggagctggcacagcgttttccagaagcaaaatgcattgctccggtggtatttgcatgcaatttaggagaaccgctgctggatgacagcttcacaaaaacatttggtgagctggaatttatggtatcccagacgccccaggtgtggattgattttcagacctttgattataacggaggactctatatcagatgggatgcggtggaagagctttttcctgacggaatgatcgggcagatgtttggcacctgctgtgagtggattgaaaaactggcaaggccggacagcgactggcagcaggtcctgccgtcggcggagctggaagatatccggttaaaacgggaccggcagctgaatctgcaagttcctaatgaaatggaaaccttgttagacggtgtgtttccatatgcagaaagacatccggaaaaaacagcggtaatccagccggataccgggcaggtattgacttacggagaactggtgcgaaagagtttgcaaaccgctgcttatttacaaaaggccggagtgaaaacagggtctgttgttgcaatcaccatggaacgggggatttcccaggtcatcggtgtaatgggaatcctggcggcaggagcctgctatactcccattgcccccacccagcctgctttccggagagcggttatgtaccggaagtcaaatgcagagtatgtattgacaacacgtgcagttatggctgaaattgaacctgatgagcaggtgaccatgctgtgcatagaggacagtgaaaagatattgccccagcagaaggcaaatcccgtttcaccggacagcagtgcctatattatttttacttcaggttccaccggtgagccaaaaggtgtggaaatcagtcacagaggtgcggttaatacaatagaagcggttaaccggatctgtggaattcatgaaacggattcggtgttagctgtttcttcactggaattcgatttatcggtttatgatctgtttggaacgttaaataccggcgcatcacttatctgcattcctgatcaggagcggagaaatgccgagtactgggccgatctcatccatcaataccaaattacaatctggaacagcgttccggttttgtttgatatgctgttgattgcggctaagagcagggggattcttctcagttccctgcgatggatttttctttccggtgactggataggactgactttgccggagcggatgaaaaatcagtgtcccaatgcaaatatgctgtccatgggcggtgccacagaagcttccatctggtctaactattatgaagtgaccctgcccctggaaccggaatggaagtctatcccctatgggtatcctttaagcaatcaaaagtactgtattatggatgaaaagcttcgttcctgtccggactgggtgccaggggaattgtggatcggaggcaatggcctggcattgtcatatgttggggaacctcagttaacagaggaaaggtttatccttcataaccatgagcgttggtaccggaccggggatatgggccgttaccgtcctgatgggcggattgaatttctcggcaggaaagacttacaggtaaaaatccgtggtcatcggattgaattgggagaaatagaagctgctgttttaaagcattcaggagtagaggaagcagttgtttttgcaaaagaactgccatcgggacaaaaagaactgctggcattcctcacaggggaagactgcggcagggattccaatgaatggaaaaaaaggctgaaacacctgattccggagtatatgatcccaaaacattttatttatcttgaacagatgccgttaaatcaaaatggaaaagtggacagaagccgtttattggccctggaaattacagaaacgcatcagacggaagaagaaaaacgcctgccggaaacagaaaaagagaaaaggcttgctcagatatggaaagaaattttaaaacaaccggaagtttatttggaagattcctattttgaattaggaggagactcgctgattgctacacagctgacggctgaaatacggaaacggtttggtgttccgtttatgctggaacatgtatttgaacagccggtgctttcccttcaggcagaattgttggatacaatgcagctgcaggatgcgggccgggaagccatatcaacaaatcaggattcggtcctgcaaacagatcctgcaggcagatttgagccatttccgctgaccgaaatccaaaaagcatactggatcggccgcaagggagtttatgacttagggcaggtatccacccattactattttgaaattgaaaataatgattttaagatcgccagattgaaacaggccttccatggatttttaaacgcccacgatatgatgcgggcggtgattttaagtgacggagaacggcaggtggttttaaaggagatcccgccttatgaactgaaagaatatcatctggaagaaatggacagcgaggtgatcgaaagccatatagaacagatacgccgggaattgtcccaccgtgtattccagccggaggaatggcctctgtttgatatcaggatttccgtgctgccggagaaaagggtccgtctgcatctctgctttgacaacattattttcgacggatggagcatcttctatttcttccgggagatcagccgaatgtatgagcaggaggagtattctgcgcgccggccggctgtcacgttccgggactatgtattagaagcagaacggatgaaacagacgccggcatttaagcaggataaggaatactggttaaaccgtctttccaccctcccgccggcaccggaattgcccaccctggaagcgccggtccatacctttgcccatctggagcaccggctttcttcggaaaagtgggaaaaaatcaaaactcatctgactggaacaggaggtatcactccatcagtatttctgatcggtgcatatgcagaaattctggcggcctggagcagacatcagagatttaccatcaatttaacacggtttaaccggatgccggttcatcctgaaatcaatgaagtggtgggggattttacttctctgactttgctggaaattgatatgaagacaggaatgactgattcctttacggaacgctgtaaaaaaatacagaaacagctgctggctgatttagagcatccgctgttctgcggtgtttctgttcagcgtgaactgggaaaatattatcaaagtcagcagggagtcatgatgccggttgtatttaccagttctctgggactgcagtcaaatgggaaggatcacaaaaactggtttgaaaaccgtatttacagcagctcggaaacaccccaggtatggctggaccatcaggtgacagaggagcagggcgacctggtcctgatttgggattatgtaaaagaactgttcccggagcggatgatttgggaaatgttccatgcatatgtaaaactgatcgagagtttatgtgagcatctggaaaactgggagaagccggatattgaactggtcaccattccccggattcaggagtttgagcaggagaatgtaaataagacagtgattcctgatgatacgctggtttcactatttgaacggcaatgtgcaaaaacgcctgaaaatattgcagtcatttataaagacttaaccattacttatggagaactggaaaactgtgtgaaacggactgccgccgagatttgcctcagacaaaacaggaaacctctcatcggcatttatatggaaaaaggaatggagcaggtaatcgcggcactggctgttatgaaaacaggcgcagcttatctgccgctggatgtccatcatcctgccgaacggattaacagtctgttagaacgggcaggagtccagatgctgctgtcccagtcctggattaaaaaagagggaatcagggccgggcaatggattgatgtggataccattccctatgcagaaacaaaagagtgcgtcctggagcctgttctgccggaagctgtggcttatgtcatttatacatccggatccaccggagaacccaaaggtgttaccattacccataaaaatgcagtgaacacaatcattgatatcaatcggcgttttaatgttacagaggaggaccggagcattgcgctttccaacttaaattttgatctgtcggtctacgatatctttggcatgctgtcagccggaggtgctgtggtaattccggagcaggcacagcttaaaaatccggctcattgggcggcagtcatggaacagcagaaggtcagcatttggaacacagttcctgcttttatgagcatgctggcggagttctgcggctctggggcgattgatgcctccctgcgcctggtgatgttaagcggtgattggattccaatgactttacctgagcagataaaacagcttttccctgctacccttctgattagtctgggaggggccaccgaagcggccatctggtctaactattatattattcaccaggtatctccggaatggagcagcatcccttatggaaaacccttaagcaatcaggtgctgtacatttacaatgacagaatgcagccctgtccggtgggagtctgcggggatctgtatatcggcggagccggtgtggccgcaggatactggaatgatgaaaaacgcacggcaggacaatttatcacccatcctcttaccggggaacggatatataaaaccggagatctggccagatatatgcctgacggcaacatcgaatttttgggacgtgaagataaccagattaaaataaaaggattccgtatcggtctgggtgagattgagcaggcggtcggattgtttccggatgtaaaggatgtggcagtcattgcagatcaaagcccgcagcagcagctatatgcatttgtaacggcaaaaacggaagaaaacccttacggccattgtgaattaatcatagctgatcatggtgatatcactgatattgcttcggatatggtgcggaaggagaatgtggatgcagtccaaaggatgctggaagagatgaaccttgtgagcatttgtgcagcggctgatattctgcgagaactcggcatgttaaccggtgaagctgatgaattttcatttgcagaccggatgattcaaacgaagacagaccggcgttttcagccgctgctcagacactggctggaacagttaaaacaggcaggcgcagttacacaggaaaatagcggactggaaatcttccgctgcagccagacttacggacagtggtcactggtctctcaaagggttcaggaactgccggtatcaatgaaagatttggcagaatattatctggaaacacagcagacttatgtggctgtgctccaggggaataaggatgttgtttctcttttccttgatcaggattttacagcggcgttaaagaaactgaattattatcagcggatcaatcagcattattacaatgcgttgaatcgtttactgaaacaatatactgataagttctttgaaggagaaaaattagctgtcctggagattggaaccagattcgggaatatgctggaagaggttctgaaaaacgaagaacgtggaaagtgggattacacctactgtgacgagtcaaagtttttcctggcagaaaaagaatcccggcatcagggaatccattttgaactgtttgatatgaatcaaccggctgatatgcagctggcaaaaggccggaagtttcacatcatactggcagacaacactctgcacagagcagctgacatcaataccgcacttgaaaacatcaggcagctgttgctgccggaaggggtattgttctttgtggagaacacaaagatgaattgttttgacttaaatattgcagggctgtatgagtacggattcagccgctttacagacgagcgaaaggaaacagggatcccctttttcaatcatcaggaatggagccgccatttgaacagctgcaaaatggaactgattgatttgttctgtgaccttgaggagatcacggctgtttatggcaggaacctttatgcggccagggcaaaagaatatgtgaaggtaattgatacggaagtattgtcagaatttctgtccggacagcttcccgaatatatggtccccaggcatgttgcagtactgccaaagcttcctgttactgccaatggaaaaattgacagaaaaggcctgcttccatttacaggaaccggcagggaagaacgcagggaaattgtttcacctgaaaatgaagtggaagcttttatttcagaaatgtggaaagagatgctgcggctggattccgtcagtgtgactgataagttctttgaaatcggcggcgactccctccttgcaattcaaagcatgaaccggctcattaagaaatatgatacggaaatatctctccaggaaattttttcagccaatactgtcagaaatttgagcagcatgattcaggagaaattaacactatacgcaggcggaatggaaggggagatataggatgaaaggaaaggaactgctgccggaaacaccataccaggaaattgttgcagaaatatgggggagagttttaaaacataaacagtttggaatagaagatgatttctttgatgtgggagggacgtctctgagggcaataaacgtgatttctgaattgagtgagaattttgaactggatattgacgatgtttttgccgcgatgacggtcagacatattgctgaatgcttgcgggagaatcaggaggcgatgaaacagaagctcaaggacattttacattttaaagatttgaaggaaatttcagacattgagctggaacggtaccggtcagcctttgcaggccagaatcagataaagccggatttcaataagtatcatcaggtcctgctgctgggcggaaccgggtttttagggatctacctgttaaaacaactgttggttcagacagacgcagtgatcactgtactggtccgcagacactgggatgctgctgaaaggctgaagaaacagtatgaatattattttggtgatggttcctatgtacagtatcaggaccgggtacagattgtatatggagatctgacaaaaaaatgtatgggcatctccgaagatctgtatggggccctggcccagtcaattgatgcggtagtaaattctgccgcattagtaaaacatatgggtaaaaatgatgattttgtttccgtaaatgtaaaaacagtagaaactgttctggagtttgcttcaacggggtgcaaaaaggcggttcatcatatgtctacaataggaatcgcttatggtgaacagggagaacatgcaaaaacgcttttcacagaatatgatgagctggtggagcatcctttaaataatcagtatttgtcttccaaataccaggcggaacagcggctgatccgtgccagaacaggggggatcgaaagcacggtttaccgcatgagcggcattttatttgattcacagaccggaaaatatcagcagaatatggagcaaagtacggcatatattttttaccgggcattgtatcggctggggatcgttcctgaagagattaagcgccccatggatatatcaaatgtggatatgatcagtgaagccataatccgtttgatgttcagcgatcaggaaatcaatcagattcatcatgtaatcaatccaaatgcattgtccattggagagattttaaaattgatgaggggaaagaatacggctgtttccttgaaagagatgtcagtggatgaagtttttacatattatcagaaaacccatccgtcaaaacgggagcatttttatgagctggcgtttcactgtgaaattatcagctggatcggtaagaaccaatacaacatttgtatggaaaaaacggtcaatgttttggaacagcttggaatggcctggaatacaccggacgcagcgatggtagagagggcttgcgatcaggcgaaaaaagaaggattctgctgaccatatgtctggaaggtgccgcttgtgcttccggcaaagagaaaagtgaaatatattattatcgggttaagtacctgccgattttttggcaggtacttttctcatatatttaacaacgttaaaatgactgtttggtacgtgctccggtactttgggataaaagaatgatatcatgatcagatgattttatacacaaattaacttatgaaaggtgaaataacccatgaataaacaaaattttgcaaaatacgtttttcttttttgcatcataggggcggtcctgttagtaggtacccgccgcgggcatcagaaaaaatacagcctgaagttctctggatcaacggcacctatgcagttttgacagagctcaacaggtgcggttatacgttatttggggagatgaaagagaacgaaatcaacaatcagcctaaggagtttttccattgttcaagcagctctatgtcggaagccttaagttttaaattggtggcaatggtctttccttccggcgatgtaacccggatctccaccacgcttccttctttcagcgggccgtttaaggcggcttttaagaacaggggaaatttagggtgattatgtttaaagacagcccaggattcctttaactgcatcaggttcattaagttcatttgactgatcctttctttcttgattgataggcatatcctagcataaataaaaaaaggagtcaatgagcagctggagaaaagaatggcttttcctaagtctttcagccgtggtataataggcgcaagggtctatgatcatgctgcagtggccggatgcagccttgcggcgcctggctcattgctttatggtacattaggaacatgaaagaaaggactgcctatgaagattgacagacttatcggaattttatccatcctgcttcaggaggaaaaggtaacggcttcttatcttgcggaaacctttgaggtttcgagaaggaccataaaccgggatgtggaagctttgttaatggcaggcattccccttgccacttctcaggggaagaatggggggatatccatcatgcctgcttaccggatcgaccggactgtgcttacctcctctgaaatgcagtccatattgaccggacttaaaagcctggacagtgtgtccggttccagccggtaccagcagctgatgaaaaagctgtccatggaccaggcctcggtgcaggtcccggaaagccacataatgatcaacctttcctcctggtataaatcctctctgtctcctaagatcgagctgatgcggggagccatagaagccagccattccataaaattctattattatgcaccaaatggtgagagggaaaggatcattgatccttatcttctggtattccagtggtcctcctggtatgtgtggggatattgcagggagcggatggatttccgcatgttcaaactaaacaggattcaggagcttttggataccggtgagcattttgataagctttccctgccttcctttgagtgttttccggaaaatccataccccgccagctttcaggccattgcggtttgtgagccggagatcaaatggcgcctgatcgaagagtttgggatggatagctttaaggaacaggaggatggaaggcttttatttgaagccggattttccggcaggggaaatctctttggctggttattaagcatgggagatcagatagaattgattgagccggcagaattcagagaagagctggcacagctggccttgggaatttatgaaaaatatgccggtaaaaggaaggacgtgcttcttgcaaccggcagtaaagaaggctataataatacataaattgacaaaagcaggtgaaatttatgtatatagcagacttacatatccattcccattattccagggcaaccagtaaggattgttctctggaatatttggatttatgggcaaggaaaaaagggatcgccatcctggggaccggtgattttacccacccggcatggcgtgaggaattaaaggaaaagctggttcctgcagaagaggggctttatatattaaaagaagaatatcgtgtgaacaagaaggagggtccggaaaaggcaattcccaggtttgtggtttccggagagatcagctcgatttataagaaaaacgggaaagtgaggaaggttcacagcgtcatccttcttcccggcattgaggaggcaaaactgctttcagaaaggctggaaaccattggaaacctacattcagacggcaggcctatcctgggtctggattgtcatgaccttcttgaaattacgctggaaatgtgccccagggccatttatattccggctcatatctggacgccccatttttcgttgttcggagcattttccggttttgattccattgaagagtgttttgaggacttaactccctatgtgcatgccctggaaacaggcctttcttctgatccgcctatgatttggcgtttgtcggctctggaccgttttcagcttgtttccaactccgatgcccattctccgtcgaaattaggcagggaagccaatcttctggatattcaattatcctataccgggctttggaatgccattcaaaaaggggagggattggaggggactgtggaatttttcccggaagaagggaaatatcattatgacggtcaccggaaatgcaatctttgcctttctccttcagaagcgaaacagtattcaggcaagtgcccggtatgcggccgcaagctgactacaggcgtttcccatcggatcggtcagctggctgaccgtgcccctggctttgttcttcccggaggaaggagatttgaaaatctggtccctttgtctgaggtgattgcggcttccataggctattccacagccagcaaaaaggttcagggccagtatgaatccatgatcagtgatctgggtccggaatttcacattctgcgggatttgcctttggaggatattgatcaagcttccggtcatatgatttcagaggggatcaggcggctgagggaaggaagagtcatatgcagcccgggatatgacggagaatatgggaccatccggctgtttgagccgggagagattgaccggaggggcaaagggaaacacgtttttacataggaataagcgtacggacgaaagagaaaagcagatgaaatacagtagcggaaggttggaataccggatgaaaaaggaaaatatcggttatatacttgaaaagttagatcaggtttacggtgtaacaaaggagggcttttaccaccagcagccctggcagcttctggcagccatcatgctcagtgcccagagcacggataaacaggtggaggaggtgctcccccagctgtttcagcgtttccagacagtggagcagatggccgaagcaccgttagaagaaattgaagaagccatacgttcgatcgggctttataaaaacaaggcaaaaaatttaaagaaatgctgcagacagattgcagaggaatacggcggagaagttccaggagatattgaaggtgttttaaccctggccggagtaggaagaaaaactgctaccttgtttctggcagatgcttatggaataccgggggtcacggtggatactcatgtattccgcatttcaaagcggctgggctgggccttcgggaaaaatccggcagaggtggaagtggaactgcagagaatattgccggaagaccattggaaccggatcaattttcagctgatttaccatggcagggcaatctgcacggcaaggaaggcaaagtgcggggaatgcatgctgagggagtggtgcgggcagacggtggacatggaagggaaaggagagaaaaagatatcatgagacttatgtttaaacagaggtttttttcctggtttgacagttacgatatttatgatgagaatggcgccactgtatacacggtctgcggcaggcctgcatggggccataagctggagatttatgataaagacggaaatcacctggcaaccttaagggagcaggtgcttactttccttccccggtttgccatccagatcggaggagaaacggtgggaaccatcaccaaggagttcactttttttaaaccctctttttccgttgactgcaatggctggcatgtggaaggcagcttcctggaatgggattattccattctttcccagaccggcagtacggtggccaggatcgaaaaacagctttttcattttacagatacttatttgattgatgtggctgacggacaggacagtcttttggcacttatggtggtccttgccattgatgcggtcaaatgcagccagaataagggctgacagccttacagctcaaaagagcagatcagaaagtcatgaaataacatagcctccctgccggtttctttgcgaaaccggcagggaggcattttcattttctaacacctggctgccatagccgtctgttgatgaaatggttatggcaacagtcatacaagttctcagatggaaatatttgctatccaaaaactgaaatggtacagagctgcttttgcatgaaatgattgcaggcagcaatgaaccacctattatcctgggttggcaattaaaaatattccgaattattatagcttatatatggtgcgccatttgcgatttttgtattcaatgttatagtttcgccggacggaagcaggcgtttctgctcttcgtcatttttgtgtatatattaattctgcgtctgcaaaggtggcggcaggttctgcaggtccggcgggcccatgggggccgggatatccctgttctccctaagaccccggtgacccttccggtccagaagatccctgaacgctgaaacggccccggaaaccgggagccccctgaatatcaggacagaaagattggcccatacccctgttatgtatgggacaattggaattgctgcaatcagataacttcaaataacaattcaccttctttcctgtatctaataaaaatgataaaagataatattatgttataaacgttaaataatacaacaataaattgtttctattatagaatacgggattagggagaaaatgtgcaaagcatagatactacttgctgagcggaaataaaagggtcactgtaaagatcttttcctcctggccggcatcaattctaatcaccccgcctaagtgctcaataatttctgtaacgattgccaaacccattccatgaaagtctttgtcagcttttgtcgattcgggaatcccgttgcgcatgctgcactccccattaaaagagttggatatttcaacactcagccaattattgccctcacttaaattgcttgtgattgtaagaaatctccgaaattcagatgtgactttggtacaggcttcaaccgcattatttgttagatttgaaaaaatgcggacacaatcaatatctgatatattgagtccctcggggatatataccattgctgagaagcgtgtttcctgctctgcacacacgttggcaatgtcatgaaaaatggcgtcaagtataatatggtttgaatatgtcttatggaccagaacctgttgctgcatggtatcgtgaatggtatcgagcatccgttctgctttctggtattctctggtggatagcagggatttcacagaaatcatcatatttttatagtcatgcttaaatgccctgtaactttccgtgtatttttgataggttttgtaatgctgcaactgcctgcgaagctgctcctgaagaaatcggttatgcagttcaaattccaaaagagcgctcattcttatcccgcgatgcaccaaaagactttgagcagcaaagcatatcacgcatgatacaatataggttattttataccagggcagatctacaccataatatcgtcctaaattgacaaatagcagataagccaatagagttgtttgaaagatagctacaaaccgtatctgctctttgatgcggtagaacttttccattttagatcggggcgcaatagtatgccgaaaaatcctgttatagacgagtataatacacatggagaggaaccatgaaatggagtagtagaaattgtcatgcctcacccattgaacgcttttttccagacacaaagcaaaagccggaagtacaatccctcttccccagtagagaacggaaacaaaataactgctttcaaataggagctgcaccggattcattttgtacattagctttaattccaatatggtgatacctaagagtatgagagctccgtaatgggatgaaaggcttaatccccaagcagccccgaagctccagtttgtgaaagcagcaattgcaagataaatccagtaaccctgtctgacaagaaaggtattcctgtgataaaagaggaaggacacgctgtaaaaggtaaacagacattccgccaaaaatcgcaaagtaagcgccattggacttctcctttctcattaaaaaattgtattgtgccggatcatgtaatccaaaaaggtgttttttaccttttcttcataagtcacacctactggtatcgtttctcctgttttaagaataatcgtgcggcgctgaaattctgcgatatactggaggttgacgatataggagcggtgtgtgcggacaaaattctttccacgcaattgctcttccagctcttccatagtgatccaatactcaaacttttcattttttccataatgtatggttacaatccctttccaaataacaaaatgcgagatctccttaattggaatgattttacgtaatgcacctgatttacagataaatttctgagttgccttactatcggacaaatggacggcacgcaaaaacacctgttcaaatttagtctcagatgtttcgttttttaacagataatatacgggtgagacatcgaaggagtcaaacacgtaatcattgctggaagtcaaaaaaataatttctgcattacatcccagttccctcagtttttttgccgtatttacgccattaagtccatccattaatatatcaaggtaaatgatgtccggcaaatcaggagtgtcggacatatgaaacagcaaggatctgccgttataaaatgcagaaagggaaatgtcgatctgtttttttttcgctgtctgtttaattaaatcactatatctttctactgtttcactgttgtcatcgcacaagaatatggttatcattttatacaccctttcctagaacttaggatgaaacgcgatgcatccgtttattcgcaaattcacatgatttttataccacttgtttaagcgcttcaaatgtatagttcaacttataagtataagtaaaaaacgtacatttggaatatatttcgtccaataaagcagtatttccgcttaattagtattcatcagcaaagcggtacttttgctttgtgctttcccaatacttccagcccatgcaatcgagcggaaattactgctcattaagcggaaaatcgggcaaatggacttttgttattttataatcagcaaatgaaatatatttcaagttaagtcatatttcaaaagccaagtatgcattaatgaggttgaatacatgaaattacatatgacaacagactatggcatccgcgttatgtgttgcctctatagcaagaacacattaattacggcaaatgagctttcggagcagctttgcatttcgtacggatatttaaataaggtacttggctgcctgagacaggccggtatggtagaggttctgcatgggcgttttggaggctatcagattgctgagagcgcgcgggaggttactctttatgacatcatacaggtaatggaaggcgatatccagatcaactcttgtttgggtatggatggtttttgcaacaagggttcaatagaaacatgccttgtccatgcggtattggactcagtacaaaaggaattggtctataatctgcgctgtgtacgcctgtctgacattgcagaaacggccaggggactgcatgagcttaataatatccacatgactatccggcgttcccgatgcgcacctgaatgaacgttaagcagatatccgatcccttgcagttatgaaaaggaaagttttaatgccagaagataaaagaacgaaacaggaaggtacaaatatcataaagagaacatatcagctaaagcatgcggctgaaccccataagcctaagctgccgttttggccttcttttataaggtgcgtgctgattgccgcaacaacagccttggtattcaacgcaatgtttggaattgcggtcgtgtcgggaacatccatggaaccagctcttttggaaggtgatgtcctcctgttttggaaactttcaagctcatataagagaggtgatattgctctggtaagcaggaacggaagtacagactatgtaaagcgtatatgcgctgttcccggtgatatgctggagtgtggaggcaatcctgaactttttcttattaatggagaagtgcccgatgaaccatacatctatgaaaagacctatggtaaagcggaaatcagttatccgcttacgcttggtattaacgagtactttgtcatgggagaccaccggggtgattcatatgactcacgcaactatggcgctgtgagtgtaaaacaaattgatggaagggcactcatcatattccggggaggtatatgagaacatgaataacaatgatggaaagatgtaatatgaaaaaacaatgtaatttgtacggcagtttttctctgctgcttgtaatattgctggtcttcggagtattgcctattacagggatcgcccaaaacgacaggggaacagaagcaatcgcgttttttgatgtggttgtgacaaaagcgactgtcccggcaggaacggaaagagagggtatttcacttcctgaaaccttgatggcaactctggaggatggaacgatagccgccattccaataatatggaaggacggtggggatataacaaagatacggcagggatgtatacgttcactgctgatattggcacatacctatatgggcaggcgcgccctgttgcagttgtaacggtaacggaaccttcttatgggtcgtccggcagcatcagcggaaggctttggctggatgaaaatgcggacggcgtgatggatgaagatgagtcaggcgtggaagattatcctgtaagtctctatatggctgatgatcctcatattgctgtacagactgccaaaaccggaaccgatggtacttaccgctttgaaaacatagagccaggcagttatgtagtgggcattgcccctgaaataatagagcaaacagaatacctgctgccagtgattggaatgtcaggagacaataaatttgagatcgttgaagtgggcgaagaaacgatcatggcatacagtgaaacgattataatttctgaggaaacagatacgggggagggggctgtgaacgccggtattcgcttaccgggtaaaaaggctgcgcgggtatggacggcaagtaattatagtcagttgaaaacatacataggccaggcagcggagaacgatataatcgtaatatcaggagacattggatttttatcaagtgaaagtattaccattaataagagtcttatctttcgttccagttccggtaatcagattaccttttcccagcccaatgccaggcggcacttcatcatagattcaagctctaacggcggtgcgattgaacttacctttgaaaatatcgtgattgacgggaaaaaaaatggtggcggattcgagattaaggctggaaaatctcttaagcttaacctcaccaattctgtaatacagaattgtaatgcacagtacggaggcggctttctgcttaatacgggagctgcgctcactcttcatggcggtaaaataaccggaaatatcgggaaaatgtacggcggcggattttatgttgattcaggtaatcttaccattcaaagtactgaaatgtccgcaaatacttcaccacaaaatgggggcggaatttacgttgattcaggtaatctcaccgttgaaagcactaaaatatccggaaatactgcgtcccaaaatggagccggaatttacgttgattcaggtgatcttaccgttgaaaatactgaaatatccggaaatgttgcactgcaaaatggagctggtgttgatgttaacaacagcattgtttctatccgggacagcagaatctgtaataatattgctcaatacggttccaatcaagggaatcatctgggtggcgggttgtatggaaaagaatccaacgtcaccatagatgacagtgaaatctctggaaatacatcaacccatggaggcggagtatactttgcttcaggcacgctgacggtcaataatacaaaaatctctaataataaagtggtaatgaccggcgggggattcagataaattctatcacaaattcaggtattacagcggctattaacatcactggcagtgaaatctccggcaatgaatcggagatgggcggcggcggtattggcatagacggtagaagttcatcagaagagatgatgaatacaatcaaggattgcagcatcttcggcaataagtcgcctttctttggcggtgctatactgagcagcggaggaaatattgcggttattaattcaaatatctccaacaatacggcgggatacggcggaggtgtatacctttatgctcaagcaacttttacaatcagcggcggtgaaatttccggaaatgctgcacttgcttcctacggcagctttggaggaggtcagggcggtggtatccacggcaggggtaacagtatcattacaatcaaggatggtgggaaaatcactaacaatgttgcagaatcagtggaaagcgattcaggcaggggcggcggagtttatttaaatcagagtccgattgtcgttgaaagcggtgaaattttcggcaatatggcaaagcaaagcggcggcggcatttacagcgaagcgaatggaaccgttaaaatccaggccggaaaaattgagggtaatctggcgcccaacggcggcggcatttacgtgacgcccctggccaaccttacggttacttcagatgaagtggtatttaacgataacattgccggcaaggctaatattaaaagtgaagttgatatgaatctgcatgcacaaaagatctatacaacacattttactgcgccatttgactttgcttacaataactttgacgttggatataagacgactgcaaccggtattttttacacagtggagtttgattcctgtggcggagatctggttcatccaaagatcgttgcacccggcagcaccattacagcaccatcacccggccctacccgtgacggatactcctttgcgggctggtacagggatattaacggcacaaatccctggaactttgcctcagatacggtgacaggtaatatgaaactgtatgcaaagtgggcgctcagcagcagcgttactgtttccaagacagtagccggtgattatggcgacaaaacaaaggaatttaatttcaccatcaggtttatgaatgaaaacggaagtaagcttccagggggaatacagtttatatatacaggcagtattatttcaggatcgggagcggaagctccggcaggcggtatgctgacactggacagtaacggcgaagcagcgttcacactgaaacatggccagcaaattaccattgcaggtgccgcaatgaacagcaaggttcaaattgttgagaaccttgctgcaggctataccacatcgttccgggacgaaaatacgatatataccggagcagatacagggatatgtacattggctgatgcagccaaaacctttgcttatataaataccagaactgccgttgtgcccaccggtgtatcagcgggaggcagtaagcccttagtttttctggcattgcccatgctgctgggagccggcctgggaactggcaaagtccttcgcagatataaaaggagtttataacatgggagaagtttataaacatgcaaaaaccaaaaggatcttaaggagccgggaaccaccaggggaaccggtaatggtatctgaaccttctctgttaatggaaattttgtttctgttagccaagattgcagcggtgctgctggtcatgctgctaggcttcacctttatgttcggcctttgccgcaatgtggacgcctctatgactcctgcagttaaagacggtgacctggtgatcttctaccgactggacaaaaactatgtggccgatgatacccttgtgctggaatttgagggaaaaaaacaggtgcgcagggtgattgctacggcaggtgatattgtggatatcacggaggaagggctgttcatcaacggtgcactgcagcaggaaacaaagatatatgccccgactcagcggtacgaagtcggtgcggagttcccgattacagtcagggaagggcaggtatttgtccttggagacagccgggtaaacgccacagacagccgcatatatggcgctgtggatttcaaagacacactggggaaagtgataacaatcctcagacgaagagatatataaaacctttgtgtttctatatataaacatgctaaatattaaataaggagtaaaaaaatgattaaaaaacaaaaaaagcggttcccgcgtatgctcttaacggcggcacttgccgtggtaatgtgcctggaagttactgcacctgcatttgcagatggcggtcccctcactggaagtgaaaccaaccctgccaaagcgtctataacaaaaatgctggacatgccggaaggaacaacgacacctgcggcgaatttcactttttctttcacaaagaaaaactatatgggagaaacaacacaatctgctttgagccagatgccggacatttcacctgtaactgttttattctccagcaccgatgcgggcagcacagacagccaaaccggaatcaaaagcgtgccaaaagaagtggaagtgactcccacctttacaagtacgggcatatatacatacgacattacggagaatgagaacacctatactattgcagatcctgcgaaggaaaccatgatttattctcaggcaaaatatgaaatcagttactatgtaaaagagaaaaacgatcactcaggtttctatgtagaaacgattgttactaaaatccttgtaaatgacgacggtacagatggttccggcgaaaagattaatccaaatcccggcggtcctacgggaagcggcagctacagcggtcttgtcttccgcaatgcctatacaaagaataccggaggcgtggacccaacaattcccgggaatcaggttcttgccatcagtaaggttgtagcaggtgattttgctgaccagacaaaatacttcagctatgatatttcaataaccaaacctgctgtgttgacggacgaggtgacctacaaggcatatgtaattgattctaccggtgtggtaacagggatgccaatgtagcttctggtgacacaggcagcattcaaaccgatgataacggcaaaaagtatattaaagtaacaacaggagcaacaaaggtgatcaacctcaaacataaccagatactggttttcaatgatttagaagttggagcaacatatgttgcgaatttacaaggtgctgtgggttatactccgaaagcccggattacttccaacggctccgtgataactccggatttaactgctcctgagggacaaaacctcagtaccggatcatggcttatcggtgagagtaagaatggtgctgattttaccagcatgtttaaaaccataactcctacgggcgttgtaatcaataaccttccctttatcatgattctgatcataggggcaggtgcgtttactgctttcgtagtagtgaaatcaaataaaagacgtgtttacggttccaagcattaaatgtcagccggtaaggctgatataaaataataccgggaaggagtccatatgaacatagcagcaataaagatcggcagaatagcagtaaaggtcgcaagcaatgtggttgatttcatgatactgacgatcattctgctgatgatagcggtttccgcctatgccatgtgggactctgaccaggtataccaggcagcagacgcctcccggttcgcggtttacaagcccagtgcagaggaagacagtgtatcctttacagagcttcaggctatgaacccggaggtgtttggctggctgactgtctatggtaccaatatagactatcccatcgcgcagggtaccgacaatgcaaaatatgtgaataccagtgtctttgggacctactccctttcaggagcaatcttcctggattatttaaacaacaaggacttccaggactttaacagcattttgtacggacatcacatggaaaaacaagcgatgttcggagatcttggttcctttagcaataagaacttttttgacagccgcatttatggaaatctgtatttcagcggcaaagatcatggactggaattttttgcctttattaagactgatgcatacgatggaggcgtatttacaccctgcatccagggcagggaggcacagcaggcatacctgcaaaacctcatggataaggccctgtatacccgggatattggagtgactgcagaagatcatatcctgcttttgaccacatgttcttccgattcaaccaatggaagggacattcttgcagcaagaattacgaacgagtgctacagcaatacctttaatacggaaaatataagggaagcaaacgggcaggtgctggtagacatgcaagacggcatctgggagagcacccctgtgtggctgcggatcacgctattaatagttttgatcatcctgtttgtaattgccattcattatatattaaaaagaaagcgcgtaaaggagtagtggaagatgccttttttacataaagcacagggtaaaagaataacaaccatggtttgtctgtttgttctattcattttggttatggtacttcccagggccgcttatgcagcggtcacttcggtgccggtcacattacgcatagaccaggtctttataaagaatagctttgctttgggtgtgaacagtgtgttttcttacacgttaacctcaatggatgccgcaaatccaatgccagcgggaagtatcagcggcgtttattccttcacagtcgatggaactggcagcaaaaatattgatccgatttcctttaacaataccggtatctaccgttatgaaatcaaaggaaatacgttttcctctgcagcaggatatagttacgacaatgaggtttattcgttgactgtctatgtgagacagccggctaatcatcttgtaacggaaattactgtccaaaaaggtgatggcagcaaggcgggccgtattgagtttaaaaacacttatactcctcttgcaagcaagcctgaaatcatggtcgatccgccggtgaaaaaaactgtatccggaaatccgtctaaagccagcaccttcacctttttactgaaagcaaagaatgaggcaaatcccatgcctgagggcagtgccaatggtgtgaaaaccataactattacgggttcaggtaagaaggactttggctcatggacatacaccagggaaggaacgtattattacaccatctctgaagtgaacaccagacaatcgagatacacttatgataccactgtttacacgattacagatgttgtgaaggatgtgaacggccagctggatgttactcggacagtgacaaacggatccaataagcaagtggaatcctgtatttttataaacaagtacagtggtggaagtagtggaggcagcggaaatgggggaagtggcaaaggcagcatcaaaggcgtagatgccggagtacccaaagccggcgcaccccagacaggtgtacctgaagctgacgtatccgaaacgcgcatacccaaagccggactatcccaaatcggcatacccaaaaccggcgattctatcagattcgggttctatacagcaatgtttttgggcagttttatcgtagcggcctgttgtattatctatctgatctttaccagcagacgcaaaacagaggaaacggtaaaagccattggcagatgaaagagaatgatgggaagctcatgagaaaaaggcaaaaaccaatgaaaatcgcagcagggttccttctaatggtttcagtctgtgttatggtgttttcctggtacaagatgagggaaagcttacagatttatgcagaaggggatcaaaactataagcagctgcaaacgcagatccggcatccggcaggtgccaatgcttctgaatcagaagcattggcgctggtggatattccgtcaatctacatagattttgaaatgcttcaaaaagttaatactgacgctgctgtatggctttactgtcctgatactgaaatcgactatcctgttatgtgctccgacgattacaactggtatctacaccatctgccggacggaacttatcatgtgaacggaacattatttcttgactacagctgtccgccggattttagcggcaggttgagcatcatttacgggcacaacatgaaatcgggcaagatgtttggttccctggtaaaatataaggaacagaaatattttgaacagtacccttacctgtacctttatacagaacagggaaactaccggatagatctgaaatatggctgtgtcatcggtgcagatcaatggcgtgaccaggcatttatgttcgaaggaaatctggaagcgctgctgtcacacgcatcatcaaaaacaacctttgaaagcggcacagaatatacggaccgtgataagtttattgtgctttccacgtgcagctatgagtttgacgatgcccggtatattgtaatcggagttttaaggccagaatatggagcataaaaacaggtacgaaaggaagtaacaaaaagtgatattaacgaaagaatcgatagatacggttaagctgacaagaagattcagtaaatgctatgatgccagggaagtggatcttttacttgataagattgcggcagcagccgatgagcagtgcagggagcttgaacagctgcgcagcgttcaggcagaatatatggagatgaagagtcagatttcggaagcgcttctgattgggcaaaaggcagcggcagatttaatggaacaaacgaagcaggaatgtgcccatgaactggcagtactgcacaagaagaaaactgtattgcaggaagaaatatcctctcttgaacggtataagattcttgcatttcaaaggattaaaaatgaaattggaaaactgcttggcgatccggaatatgcggagacgccgccgcaatatgcaatagaaaagaatgaaacagacggtcccggcaatttgcccgaggagatagaatgtaaataaggaggaaggtcaaatgaaaaaatggagtacaattgtcttgtgtgcggttttgtttaccggattggtcgcacgagccatccttccggtatctgcacaggaggaaatccagcttgatgagctccaggctgcagagtctgagcctcaagttacagagtctgagcctcaagttacagagtctgaaccccaggacaacatggagccgattccaggagatggggagtatcctgaagaaagcgataatgaggaggaggatcaggaagcagctatagaccaaccggaacaaagcgaatccctggagacctccaaagaaacggagggaaccccttcccaggctatgccagatggatctgactatgaaggagaaaatctgccggaggcaggaactggtggaagcggtgggattctgattcgggaggagctgccagtcctgcaagaaaacgagagcaatccgaatgttgcggaagcgatgcatgccgcacacagcagcctggatgagcgcattgattatatcgctgatttgctgggcatgtcagaaacctatactctcatagaaggggaagataatttttgtgaagcactttccatctatgccataagacatggacagaccgagaattatccctatgagatacaaattacgggcacggatgactttgctgagcttcaatccatatattggagcctgaatattgtaaatggagcaaaaacaggagcaaatgctgtgatccgtgtagtgcagccttcgggtatggatgtatacaatctgtcagattccgaacggaatgtatatagaatacttaattctgaagagaacaaagaaaaaatcagcgcactgcctcaaggctgatatagctgtaagcacccgaaggatgagaatcctttgggtgttttttatttttccaatcttccaatccatgatcatcatgctcacagctgcttaaacggttgctgtaccggtcatacaaggcccggacagaagaatctccctaaaatgtagtcaataccaataggttgtaaatacatacaaaatatgttatactgctaatgcattttgtaagtaaggaagagggcataagcatcataaacgaactgaaatattggccggtttatgggatcaaaaggtattttatggtaggtttagtttactcgaaaagacctttcttccaattttaagatttatgagaaaccggagtgtacaacatttgtctttaacttgaaattagggcgaatatatattttagtactgttgaaataaagatgacgcccgagagaaaggttggtgaataattatgatgacaatatttttatgtgatgataatcaaaatacctgtgcagaatatgcccggttgattaaaaagattgcaaagaaaaacggggtggaggtcattgttttctccttcaacagcggggaagagctgttatttcacttggcagattcacccaatcgggcggacatcatttatctggatatccttatgggtaaactgaatggtattgaaacggcaaagaaactaagagaacttcaatgcagttcggaaatcatttttctgaccacaagtgaagattttgtttataaagcttacgatatttctccggtacattatctgctgaaatcaaaaacgtccactgctaaatttgaggaagtatttttaagggcaatgactttagccctgaaaaaggaatacgatatgttcctttgtgagtcggggacaactcaaaaggtaattcctgtcaaggatatctctttttttgaaatcaggaaacgaatcataacagttcattataatggaggagaaagctttgatttctattcgacaatggagcaattggagaatcagctgcttcacaagggattcgttcgcattcatcgttcatatattgtgaatttgttttacatttctcaatttcagaataacattctatatctaaaaacaggtgaaaaagttaccgtaggcacaacatatatgcaacaaacgaaaaaagcttttgttgattatgtcagtcacgccagtatccatgattgcggaaagggagaaaatcatgtcagggcttatttcactcattatttatgatgtttttatctatcttgattacaaggcggtgtttccgtcgaaaaggagccattggctttatggcgcagctgcgcttgccgtcaatatcggtgttgccgtgccagcctatttgctgctggatccccggtttgccatttatctcattataggttctgtaatgctggccaaccatttgctgttttatgtaaactacatgcagattctttatgtaggcagcatctacatgttttccttatacagcagtatgggcatagtcttttcgctgtattccattatttttcataccagcatcaaagacattttcttgcgggatatccagaatcaggtaatgcttccattagttgtgctgctttcaatcgcatgggatttactttcccgcaagttgattgttacacataaaaaggccgggcatttgcttcataacaggaggcagctgaaattcgttgtcatttacctttttttccaactgctgtttctcacacttattaatgatggccgttattatgacaacatcagatcctctgcttggttcactgtactttatctgggcgcctgcattatcagtaaattatggttgctgtttgtcctgcatcatacgactcaggtatccgaattgtttgagtacgagttgtatacctatcaattacaggatcagctttcccgccaaatgcgtcattatcaatcctatcgtaaatatacggaaagctatcgggcatttcggcacgattatgaaaatttgatggcttctttaaaagctttgctgaaccgccaggaatataaaaaagccatacgaatgttagacggcatccatgatacgatgcagcggaatgtacttgttcacaaaagctattctgacaatattatattggatgccatattaaaggatgcggccgatgtttgtgaagaaaagaacatccatttttccgcacatgcatatcttccggaaactgtaccaatgacggaattggacattgtccgtgtttttgcaaatatcattaacaacgcaatagaagcctgcaataagttgtccggtcaggaacgattcattgaggtaaagagcaacggaaatcagaattgggtcatcattgagataaccaattcttttaacggtgagttattgatagaaggcgatgaaccggagacaacgaaagaggacaaggatttgcatggctttgggctgcgaatcattaaggaaacgattgaaagccttggaggtttagttgtaattgatccggataaggaaaagagagtgttcaaaatcagggtctgtatgcctcagaccccataccttatggattttaaagaaaagtccccatcaatttgatgacggcctgattctttacttgtaatatttattctcaaattcggtccacgacttagaaaattcgtgattttgaaacgcttccttcaatccgctgatttgttttaagcggataatttcatccggctccatgcccaggttttttcctattctggcctcggaccagcccatttttgacagcgtaacgacaatctcgctcatagaacggatttgatgggttcctctcgcccggttatggcggatcgttgagccaatgcgttcatccaggggtttgtcaataatggttaatggcaagtaaccatggcgtctttttgcgatgtcgggatacctgccaattttgttgcggtgaaatccgtctgtaatttcgtagtgatcgttgtcgatacggtaggatacgattggctgtgtaaaatcgtccatgcggatagacgtataaagcagctccatttcatccggggcgaccttgttgggattgtaatcattcgcctgtatttttttggcggggatccactccaccagatccacaggatcatgaaacggggaacattcatttaaagcccgccggatcttgttcagagcctgtatcttttcgtgcagtttcattggataaagaagattcctgatgttttcaatacagttttcaagctccgtattgcaggtttctgatgttttcttttctgtgaatttcataagtgtcctcctgaccttctctgcataaaaaccagtagtgtttggtggttcgatatatgttaaaaccctgcttcacataataatccttaataaactcaatgttggtagaggtatgcacgggcatgttaatttcgcagcaatatttgaaccgggcttttgttaaagctttgaacaaaccttgccttcggtactttgtctctacatattccgtggaaaataatatatattcactcttaatcagcagagatgaaaaagcggcgacccgtccttctctttcgatcaggaaccagacccggtcaggttcgttgcgcaggtaaggcatttgccgaatgtatctctcctcggcgaaaaagcgccccatcttggaatagaaaagcgctttatcgtattttccctcaaaacattgtatttccatgatccacctccatgattatctcacgcatcttcttgtcctgcgcgtcctccaaatgtataagattctggtattgctttttaagctgaatcaatagctctgcgtctgattttgacggtgcaaagctgagccggcgcagccaaaaatcatttttttcaatagctctggctatccgcctccaggatggtatctttttcttcgcctccagctcccggttggcttcgtctggtatgtgatccagctggaatccatgggaagaccaccatttcaaataaatctttattttgcggtggtagtgatccctcagctcaggagaataaaggccgaggctttcaagcagtaatacggtatattgctgccaggtcagtcctgcgggcttctcagacttcatgtttcccagcagtgatgatctggcatagatatttccgaaattcacgccatgcaccctgtttacaaccttttcccaggtctcagactccagcgcacggaactggtccaatccgttgcgctggtcatccccgtatggctggcagagccgctgcaaatggatgctcaccccgtttttgtacatcagctcataaatctcattataggcaagtcccaaacggctcacagcgccccagatatcttcagttcgccaatcgtacagcggatagaaatgatagatttcgcaatcaggcccagggacccgcagctttgttgtccatccgtaatcctgatacctttcttttcttttgcttataatggtattgagacggttaagactttcgttgctccggatagcaatgccgaccccgatagtattgccgtgggttttttggaaccattggctgaactgatatgtaaattcttcaaactccatgccccgataaaaccatatccagtcttttggcaggttatcttcgtttatcacacaggcgtattgcggcatatcccgcacccacttctcccgctcatctggatcccagcagatccattttggctgaatgacggatactgcgttgcgaagtgacaggggcaggcagcaccagtaaaacctgtccactacatccgctgtcatccggcgcagttcttcgatgtgatgaatcgtagcctgatactgtgcttccagatcaatatactggacgctgaattttttgcccctcagccgggctatgtatgcacagagctggagcatgacggacgagtccttgccgccggacacgcagaggtataggtgggagaaatttgaaaacgcgatgttaatccgcctcattgctgcagttaatacatcttctgaggtatatattttgggcatatagatcacctctgttttgtgtattgaaaagctggatttcaataaatattatctttagttctttctgagtatagtctttccggctcataattaaaacatgatttgttcccaattaccagaatcatgtccccaatttgccccagtttataacataccggggatttttatcacataaacccgttgtataaaacgagggacaatctattgtaatggtactgtaaatagatgtatccgggccaatcaggagccaaacagatggagtaaaatcaggacagatgacgtgagcgatgtggagggatttattattgccgaaagcggattggtaagctgccgtgtcggcggagaaactttatttatactttcaaaaagctgcacgccgttgcaatcggtgtaatctacgctgcataaaggggggatcggtaaacgcatgttcatatgcaaaatattgggaggtgttttggtatgaagtaacggaaatgtgggattgcgcctgagacaacagcacaggtattgcctgctccttccgcattacctggctcgctgtctttttgaactccttgagaagatgctgaatcagttattgtaattgtaaaccagtgttgagctttagtttattccaatatcacaaaaatgaagttttctccggtatgcttgatgaccagggacaaacagcacctgcagattgtaaaatctatcctccggcgttttattaaggattatccttgaggtacgttgtctctccagaaatgaacaggtttccagcctaagatgtttttggctttttcattggaatataaagtctgatactcatcaattggtgtacgaatgtcggtcacatctggatattcagctctcatcagatcacaacttttgatgtccatacagttatcatcagcggcgagattcattacaatagaaccgagtccctctttttcgatggcaaggcggcaggccacagcaatatcacgggcatcaatataattccacataagttgttttcgtttttttgagtcatgaataaagccagggaagtttaaatacttttctttgcttataatattgccgatccgaaacgagacaatctgcattccgcagcgtcggtgaatggcatcagcaatcgtttcaccaacaatctttccaaggccataactatcttcgggaagtgtaggatgttcttcatctatggggacgtaaacaggtgccagcccctgacgagagttgcagataccgtaagtacattcgctggaggcaataaccgcttttgtaattcctaatcctgccgctgcttcgagaatattgtatgtacctgttacattattttgaaatgtcacctcattgggataaatgtatgcggaagggattgcagcaagatggatcactgcataggcgccttctaaaattccataacactcgcccaaattggttaagtctgccgtcatatgccgtgtcaaagactcagccggttttattttgtctgcactcaaaacctcatatccctgttctaaaaagtgcttaactacataggagccaagaagacccgcggttccggttatcactattttcttcatataccaataattcctttctttattgtggatgtatgttatttggcagtaatactgtgtgataattataaaccttaacgctaactttaagtcaacagttacttgcttttttattgttatgatgtttttggcatataaaatttaattctaacttcatgattgtaggactaacttcagtttgtaaaggtaaattcattctgcatgatgttagtcttacacaccgttttatgttatgatgtttttggcagtggatcctccatattttcaggaggtatacacaatgaattctaagaataaaacttacaaccggaaacacttgaccatgacccagcgcatatggattgagaaagaccccgctactgttttgaaagaagtgaagcgcaaccgcttttctccaaaacgaagcgaggtctggaaacctcttccatgtaacagaaaaagagaatgccagattcgttttctgtgcaatggtttggattgtactaatctttgtaaaagctgttacacgcctgccagagaatgtaaaagctgtattgatatctgcccggactatctgccaaagaacagcctgaatggaggcactccattcaggctgtttcatttaactctttatcatattgctaagcttacgctcatggatacagtgctgcaaaagtataatactaaggtgcaagctgaagcagtttgacactaagcgatgcgttcgcattggctgccaggctgactgtcacaggtcccgttgactgcagtgccaaatcgaggactgagcccgcacctagcgccagaatgacactcccctggatgatggtattttccgtgagagacaaaagaacggattgcagagtagaagtaaggaacgtgcttcctccgttaaaacgcactccggcattaattgttgtagtcgttgcagctggggcgaaacgaatcatgaagtttacctcgtaaaaaccagagagactaacttgaatcgtattactgccaagaacgacgttggaagaaggcatctgggttgccagagcaacctgtgatacctgatctgcggcggtaaaggtaaatgactggggtacaattgaaaagagtcccccgtatgcaattgtggtttctccttgtggacccgttggtccggtaggtccctgtataccctgaggtccttgaggcccggtaggtccaatgggcccctgagcacccgtagcacccgtagcaccggtagcgcccgttggcccggtaggtccctgtaatccctgaggcccttgaggtccgataggcccaactggtccctgagcacccgtagcaccggtagcgccggtagcacccgttggtccggtaggtccctgtaatccctgaggtccctgaggcccggtaggtccttgaattccttgaggtccttgaggtccctgaggcccttgaggtccttgtaatccctgcggtccctgaggcccagttggcccggtaggtcctggacagcctcttggtccggtcggcccggtaggtcctggacagcctcttggtcccgttggtccggtaggtccctggcagcctctgggtccttgtggtccaggacaacaattgcgttcatcttggtaataattatcgtccctatttctacaattactcattataattccctcctgttgaggtgcgaaaatttggtttctgtaaatagcaattctgtttttgattaaaaccagaatataaaggatgtttgtactcctttatatcttaatatatgtattgaaagacaggtttgttagaaaacagatcactgcgaactgaagggaaatatttcgtttttatttggtgcgccataggttttaaaaggcctgctgcagactaagcagcggcccttttcagaaagttaagacaatgttaatatgtaacaaacgtcttttctcttatggagattttgatttctaaaagagccataagaaagaaatatagtctgtaaactgatcgcttcaaaaaatgttcatagaaaggattccagtataaaaacaactaagcaggcggctatggaaacctgaaaaagacttttttccttataagccagaatggcagctgttaaaagtgccccggcaccggaccatatatttttagtggcaataagaatagcaggaaaggtcattaccgacaacgtcacataaggaacatagtaaaggaaagaccggataaaagggatctttatttcctgccggatcagggtcagaggaaggacgcggattaaataggtaactgcggccatgaccagtatgtaaagatagattcggttattcatgggaaacctccgtagtatcaggaaccggaaagaaaaaagcagcggctcctgcaattgcaacagtcagtatgatcagcctgaatccggaagaaatcctgtgcagtaccggaatcagaaaaaacaaaaggcttaaaatcatggaaacagcggtcactcctgccaaaaccttatctttctttgcaggcggaatgataattgccagaaacatcccatataaggctacgcccaaagcgcttagagccctttctggcagaagttgtccaaagaaggctccggcagcagtcccaagtgtccatcccggaatggccggcagaaaaaggccgtagcagtaccatgggtttaaggggcccggcctgcacacggaaacaccgaagatttcatctgttattccgtagctgatcagcagacggtgataaaatggggttgttttgtcgagcttttgggaaatggaacaggacatgagacaatagcgcaggttaatgaccagctgggcgacggccatttcagcgaagggagcgcctgccgtgataatacccagaccggcaaattgtcctgcggatgtcagattggtaagggatatgacaacagactgccatggggacagtccataatttaatgccataatcccaaaggtaaaggatacggcaaagtaaccaagacagatggggattccatcctttatcccggattttagctgttctctgctggtattcataaagctcctccctcatagggcgtgaccaccccttgttatgcttataaaaatataccatgaatctttacatcagtaaaacaaatgtttataatgaaaacattagaaaaactgatgataaggagctgggaatatgaagcggtaccgggcagttatgaagattgtggaaacagggggatttaccagggcttccgaagaattagggtatacacagtctgccatcagccagatggtgcagtctttagaggaagagcttggtgctgtgctgtttatccgttccaaaaaaggagtcatactgactcctgacggagcggagcttttaccctatataaaaaatatataccatgcttacagggagcttacggaaaagcgaaaagagatggaagggatccagaatgctaccatccgggtcggcacttttgccagtgtatcctgtcattggctgccgggattgattaaaatgtttaaagaaaagtacccattggtcagctttgaactataccaggggattatacagcaattgagcagctggtaaaggatggaagcgtggattttggccttatcaatcccctggcagtgggggatcaggaacttaagaccatcccgttaaagaaggatcccatgctggccgtcctgcccctttcccatcccctggccaggcataaaaggatcgtgttaaaggaactggcatcagaacctttcattcttctggaggaaggaagcttaaatgaaccaatggaatgctttcgtgagcatggaattgagcctaacctccagtatattgtccatgatgattatacgatcatggccatgattgaaaaggggctgggagtcgggattttatcagagcttatattaaaccgtgtaaattatgatatatcggtaagagagacagagccgccattagccagaaccattggtgttgtttttaaggataagaaaattctgccctttgccagcaggcggttcctggaatatctcacagaagaatatggggaactggacgccgggatctaatgcggccgggaggaaaagaggagctttaggaaataatgattaaccatggaggatgaaagaatgaggcatgaaaatttaacaaccctttgttatatagaacgggagggcagatatctgatgctgcaccggattaaaaagaagggtgacatgaaccaggacaagtggctgggggtcggaggccacttggaggaaggagagagcccagaggaatgtcttttgcgggaggtaaaggaagagaccggattatccctgcgttcctaccggctcagaggcataataacctttgtatcagataaatatccggatgagtacatgtttttgtacacggccgatgcatatgaaggggccttgacggaatgtgaggaaggagagcttaaatgggtgcccaaagaagaaacaggcgggctgtctctctgggaaggagaccgtattttctttgagctgttattggcggacattccgtttttctctttgaagcttgtgtacagaggcgatcatctggcagaggttttgttaaacggtacgccgctgccgccgccctggcctagtccaaaagttccttcttcgcaaaaagcccatagctgatctgatacattaccagattccaaaccagtaccaatatgggagaaaggcataagaggataaatatggagcgacctgtaaaagaaacacccagcaaggttaaaagcttatagaaaccaaagcagatcgcagcaggaatcgtacaggaaacaaacaacaatatgcgggctttttccgcaccgaatttaaacagaagcggaatggacatgcttcccatgatttctgcaattaccagactcgctccactggtaagcagcagcgtgagaacattacttgggctgtttaaaataacctggtgaataaggaggccgcctatggagccaatgaccaagccaaagaaagcgccaatggctgaaaagatcaaaagaacaacaaattttcccactaccacgtcctttttggtaaccggcattaccatggcgtatttcaaccatttggaatgatcatcaaagctgaatgtggtgatgatcatcatgctgaatagaatgccgctagtaataatataggattccactcccacagaaggaataagagcaaaagctaaaataagctgcgaaaaaagcatggatttggcgttatgtcccatgttatataaatcttttaaaaccaaacttttcattttacctggtctcccttcacatagagaagaaggatatcgtcaatggaggcatcatctaccacggacgccttgtacttgcggcgtgccttttccttatctgccaccagcacatcccattgatagtcacgtttccgataagcaaggatctctgatttatcgatagcatcgaactgagccgttgtgcatctgatgatcccataatgatagcgtaattcatctttttgtttacagaacaggacctttcctttatgaataaaggtgatgtaatctgctactttctccaaatccgtggaaatatgggaagacatgaggatggaatggtcttcatcctgcacgaaatccagaaacaaatccaggatatcgtcacgcatgaccggatcaagtccgccggtggcttcatccagtatcagaagcttcggtttatgggagagggcaacggcaatgccaagcttcatcttcatccctctggaaaatgttttgatctctttgcggggcggaagctgtaactttttcaaatagctgttgtaaagggtctcatcccactgcttataggcagctgccgaaatcctgccgactttttcaggcgtgagtgtttcatagaaattgattccttcaaatacgacccctatgtcttccttgatgcttttggaatcggaagaaagttcctgcccccaaatttcaccacaccttcatctctttggatcagatcaaggatcccattgatggtggtgcttttaccggctccgttctcaccgatcaatcccataatagctccttttggaacggaaaatgatacatgatccagcttaaaatccggatattgttttgtcagatctttaacctgtaaaattggatccatttttattcctcctcctggtaaaacatggtcagaagctcaatcagcttgctcagtgaaataccgctggtgcgggcgatttcagcggcctcctgcagatgctcctcggccttgcgctgctgttcttcctgaaagaaatctttgttttgtgccgatacaaaactgccccgtccaacggttgtctcaataaagccatcccgctgcaaatcttcataggctttttgtacggttatgacgctgacatgaatggatttagccaatgccctcatggatgggataggatcacccgtctgcagttctccgctcataatcagcgcttttatttgggaagtgatctgctcatagatgggcttatttgtattactgctgattataatctccacagtatatctccttggtgttgtgtagtgtacttattgaataagcacattatatactttgcttttcgccttgtcaataggaaaaagtaaaaaatccggcaggaggaaggaaaagggattgaccggattttctttccgtggtatagtgatgaaagtataaatgataggatgtgtgtgtttgttaattgtatttaatcatggagcataaggcagttttatatgaaaagcaggagtgggatgaggaaggctacaggtcttacctttatttcttgtacctgttttgcccatggaatacaaagcagacagaacaaggcggaaagcctgtaagacgtcggtttgtagtcttacaggctttttttgtgcaggcaatgagccgaacgaatatgcttgcacaaccattacctgcctgcccctatgctccatgaacctcaggaaaccagttggaaagccagaaggaatgaggagaattacatggatcacacatttcagattttagaatttaatcttattttagaaaaactcgaagaatttgcacacacagaaacatcaaaagagagaatacggaatttaaccccatgcttaaaggaaggtgaagtgaaaaaaagccttcgggatacaacggaagccaaaactatcatcgaccggatggggcttcctcctgcagtcagcatgaacggcttgcaggagatcatgaacacagcaaggcagggcggctgcctgtccgcagaggagctggaacgcacaggcgggatgctcaccgcagtaaagcgatttaaggactttttaaaccggtgtaaatatttagagcttggccttccttattatgagcaggatttgaacccgctggaagatttggcaagagaaatttatgaaagtgtcagaaacggaagggtggaggacagcgccagcaaatatttgaaaaacatccgtcaggatgtggccagattggaagaaaaactgcggacaaaagcggaagccattttaaggggaaataaaaaatatttttcagattcctatgtgacattaagaaacgggaggctttgccttccggtgaaaaaggattacaggtcattggttccaggcagcgtcgtcgatcagtcctcaaccggttccaccctttttattgaaccggctgccattatggcccttaatggagagctggagcttttaaagattgaggaggacaatgaagcaagaaggattttgtatacgctcactgcctcagtagaagaaaatttagaggtgctggaaggtgataaacgccttttggaaaagctggatttcctgtttgcaaagggaagcttaagcgcttcaatggccggcattgaacctggaattaatacggaccggatcataaagatcgtaaatgggcgccacccttttatgaacccggaaactgtggttcctcttgagtttgaactgggaaggaaagggcgaggcattgttattacagggccgaatacaggcggaaagactgtagccatcaaaacggtggggcttttctccctcatggctcagtgcggacttcatgtaccctgtaaggaagcggatctttgcatgaacagtcaggtgctctgcgatattggagatgggcagaacattacagaaaacctgtccaccttttccgcccacattaccaatgtgatgaagattttagaggcagccggcccggaaagtctggtcatcttagatgaactgggctcaggaacagacccggcggaaggcatgggaattgccattgccatactggaggagttaagaaacaacggctgtcttttcctggcaaccacacattatccggaggtgaaaacctacgcaaaagaagcggaaggaatcaccaacgccaggatggcgtttgacaaggagactcttaagcctctttaccgcatggaaataggagaagcaggagaaagctgcgccctttatatagccaaacgtctgggaatgccggacagcatgataaggagagccagaaggtatgcttacggagagggggaaagcttacgggaagaggagccgggctctttaaaagaagagattgattttgtaaaaacaggcagtcccaaaattgaaaagctgaaaaaagcgtctgggaataaaaatgtcatggaacaaaagttcaccattggggacagcgtttttgtctatccggaaaagaaaaagggaattgtgtgcactcctgtcaatgagaagggcatgctgcaggtccagatgccggataagaagatctggatcaaccagaagcgggtgaagcttttagtggcagcagaggagctttaccctgaagattacgatttttccatcattttcgataccgtggaaaacagaaaagcaagacataagatggaaaaaggatatcagaaggacctggaaataagaatggattaagtttgccggaaaaggggtatgcctcatgaagcgccccttttccggaagatgccatggttttatgtaggttcagagatgtggctgtcaggaacggcctcttccgcgcaaaccttgtagttggaggccggattaaaaagatcgttgttgagctcggccaggataagccggaagatctgcacatggcaaagctcatctgcgatgatcctgtttaagattgccttgatccggcagtcttcgatccactccgcctgggcctgatattttttaatggcttccagttcattggccagggagttggcaaccagggccccgatccgggtgggataacggttgcaggcaggagtccaataccttgtgcgcccgttttgatagctccacagcctggggtccgccccaagcaggagggccagttcaccaaaggtatttagatgatgcatttccacaatgctgatcttatggaagcattccgcaatatcgaagaagtagcttctggtgatcatactgttgtaaatgtaaaggctgattgcggacatttcggaattacaggcgcctatgttggaaagcatggctgctgcatactgcttattttgagaaatgctctctataggaggccagggagtgttgtctgaaaaagcaagagctgataaatccatatgataccctcattttaatttgttctattttaaatatatccgccagatggtagagtatgacttaaaaacacaggaagatggaggaagtaaggacatggaatgcagagaaaaatttaagaaaacagtagaagcctttttgccctataacgagcaggaagaaaaggataaggagatgattctccgatatctgtcatcaggggagccggtattttccagggaaagtacaggcgcccacatgtcggcatcggcctgggtggtaaacaagtcccgtgataaggtccttatggcctaccataatatctatgactcctgggcatggacaggaggtcatgcagacggggaaaccaatctgctgatggtggcggtcagggaagccatggaggaaaccgggatcacagccgtaaagccggtttcagaagatattttttccttggaagtgctgacagtggatgggcatgaaaagaggggagcctatgtttcctcccaccttcacttaaatgtgacctatctcctggaagcggacgataaggaggcacttcacaaaaaagaggatgaaaacagcgccgtgggctggtttggaatggaagaatgtctgacggcggtaaatgagccgtggatgagggagaggatctacaagaagcttcttaataaaatgaaggataggaattattaacagaaaattgataattattttctaattttctgttttatttttcctgataatgttttataatagaggcagctaataaataaagttttgccaaataagacagcgaggtggtagatatgaagataatttacgcgatcgtcagctccgatgatggaaacagggtgaccgatgtgctgaatgaacaccagttcagcgtgacaaaacttgccacaacaggtggtttcttaaaaaagggaaactctacgttaatgatcggtacggatgacggacaggtagaagaagtcatcactctgattaaggatacttgcggaaaacgccaaaaaattacctgcaacgttccggcgcccaatattgcgtctgtatcggccggatatatgatgatgccgatgacggtggaactaggcggagctactatatttgtgactgatgtagaacgatttgaaaagatttaagaaatcagcaaagggattgcagagcaatcccttttcgcaactgcgggaagggtatgccggaagaataacaggaggtgtgtttttgaaactggaagagaaaacaaaaaacatgctggtggcagaggcttatgaggcacagaagatggcttatgtgccttattcggatttttgcgttggagcggccctgcttgcaaagaacggaaaggtatacaagggctgcaatattgaaaatgcctcctttacgccaaccaactgtgcagagcgtacggcatttttcaaggcagtctcagaggggatcacggaatttgatgccattgccatcgtaggaaataaaaggggagaaaagggagaactatgtgctccctgcggagtttgccggcaggtaatggcagaattttgcgatcctgaggaatttaagatcattttgggagcaggagaggaagcttctgtatattccttaaaggagctgcttcctttgggatttacgaaaaagaacctgggttcccagtaagagggtggggtatcccttgataccccaaaagatatggcaggatcaaggcgtgtataagggaggtttcagggtattatgaggatgtatgatatcattgcaaaaaagcggaatggagaagctctgacagagacggagatccgctttatgatccagggctatgtaaagggggacattccggattaccagatgtcagccatgctgatggccatttatttaaaagggatgagcgatgtggaaacggccattctcaccgatgcggtggcgcattccggcgatatggtggatttgtccccatccagggagtgaaggtggataagcattctaccggaggcgtgggagataagacgactttagtggtggcgcctattgtagcagcctgcggagtcaaggtcgcaaaaatgtcaggccggggcttaggtcatacgggagggaccgttgacaaaatggagtccataccgggaatgaagaccgtgctgacagaagaggaattcttccaggtggtcaataagaccggtctttccgttatcggacaatccggaaatctggctcctgcagataaaaagctttatgcccttcgggatgtgacggccactgtggacagcatccccttgattgccgcttccattatgagcaaaaagctggcagcgggaaatgactgcattcttctggatgtaaaaaccggaagcggggcatttatgaagactctggaagattccattaccctggcggaaaagatggtggccatcggggagcatgcaggaaagagtactatggcccttataaccaatatggacattcctctgggaagtctgatcggcaacagtctggaagtcatcgaagcggtggagacccttcgaggcagagggccaaaggacctgactgaggtctgcctaagcctggcttccggcatgctttacctggcgggaaagggcggtatggaagaatgccggaagctggcagaaggagccattgccgatggaagcgccctggaacggcttattgccatggtggaagcccagggaggcgatccttcggtgatcagggatacaaggcttttttccaaggccccctttgaaagacaagtgaaggccttaaaaagcggctatatcacccatatgaacacagagcaatgcggaatcgcctcctctcttttgggagccggaagacttaccaaagagagtctcatcgattatacggcaggaatcgcccttaagaaaaaggtgggtcagacggtggaagagggtgagaccattgccgtgctctatacttctgtggaagagctgtttgcagcttctgaggaggaatttttaaaggcagttaccatcagcgggcagaagccggaggccgaacccctgatttatgccagtgttacaaaggaaggcgttaaacgcctgacagaatagaaaggaaggaaaagataatgacagatttagaaatgttaagctatgtagaccatactttgttaaaggcatttgccacatgggaggatattgaagagctttgtaaggaagccgtggaatataagactgcctccgtgtgcatcccgccctgttacatcagccgggtacatgaggaattcccaggccttaatatctgcaccgtggtgggctttcctctgggctacagcgtaaccgaatcaaaggtccttgagacaaagaaagccattgaggatggagcttctgaagtggatatggtagtgaatatcagcgatgtgaaaaacggagattacaataaggtggaaaaggaaatcgcagaactgaaaaaagcggcaggcggcagcatcttaaaggtcatcattgaagcctgttatctgacggaagaagaaaaaattgccatgtgtaaggctgttacggcagcaggtgctgattatatcaaaacctccacaggatttggaaccggcggagcggctttagaagatatcgaattatttaaaaagcatatcgggcctgatgtaaagatcaaggcagccggcggagtgaagaccctggaagatttaagggcttatattgaagcaggatgcagcagggtgggcgcaagcgccgcagtgaaactggcagcacagaaaaagtaaaaaaatcccctctggtccaaaataaaaggccggaggggaatctttattccattaatgataaatctttttctcttcataaataggctcgcaggtcaggtttacgcccagctttttaaatatcttaacatccacgtcagaaagaagcacggaggtatgagcttcccgtccttttaacttgggaagctgctccagagcgatctgggcattgggatcggcagcagcacaggcggacagggcgattaacacttcatccgtatgaagccgtggatttttgcttcccagatagttgatctttaatttctggatgggctcaatggcggaaggagaaatcagatggatatcatgaggaatgtttcctaaaaccttgaccgcatttaacaggagggcagccgatgcacctaataagttggtagtctttcctgtgacaatggttccgtcgtccagctcaagggcagcggcaggagagccttttatttcagccagctgattggctgcattcacaacctttctcatgccggtagtaattttggcttgtttcataagaagctcaattttatagacctcttccttggatcccatatcccttgccagacgggaaagagcctggtaatagcgtctgatgatctcctgcatggaagcttccctgcaggcctcgtcatccaccacgcagaagccggccatatttacgcccatatccgtaggggatttgtaagggcattcaccgtatattccttcaaaaatagcgcttaatacaggaaagatctccacatctctgttgtaattgaccgtggtcttaccataagcctctaagtgaaagggatcgatcatgttcacatcgtttaaatctgcggtagcagcctcataggccaggtttaccggatgctttaaagggatattccagatggggaatgtctcaaacttggcataaccggccttgatcccccgcttgttctcgtggtagagctgggataggcaggttgccatttttccgctgcccggccccggagctgtaataattacaaggggttttgtggtttcaatataatcatttctgccgtatccttcgtcactgacaatgagagagacattgcttggatagccgtcaatggtgtagtggcggtatacctttatgcccattttttccagcttgcttttaaataagtcggcggaattctgtccggagtactgtgtaataacaacgcttcccacatagagtcccttatccgtaaaggactggatcagacggaacacatccacatcataggtgatgccaagatcatgacggatcttgtttttctcgatgtcggcagcgttgatggcgatcacgatttccgcctggtccgacagctgcatcagcatgcgcagcttgctgtcaggctcaaatccgggaagtaccctggaagcgtggtaatcatcaaacagcttgccgccgaattccagataaagcttgtccccgaactggctgatccgttccttgatgtgttctgactgcatggttaaatatttgttgttatcaaatccgaatttcatttgtccctccatgatgtgcgcttaccttatagccatgttgaatagcatggctgaatttgaagcatgcacgaaatctttgaccgtaatatttataaattgtatcatataagttatgaaattgccacggattttttcctgcccccttctttttcctgaaaccctttacaatcggctttaaacgtgttaaaacgttgtagtaagaaggaggatcgatatgtttaaaataggaagaaatgatgcatgctggtgcggtagcggaaaaaaatacaagaactgccatctgtcttttgaccaaaagcttgagaattatgcggtcatgggagatgaagttccggagcactatatgataaaaacaccggctcagattgaaggagtccgccgtgcaggagtcgttaacaacaagattcttgatctggtggaggagattatgaagccgggcatcagcacggaagatatcaatacccttgtgcacgaaaataccatcaggctgggagggattcccgctcctcttaattttgagggatatcccaagagtgtgtgcacctcggtcaatgatgtggtatgccatggaatcccggatccaaaacggatcttacaggaaggcgatatcgtcaatgtggatgtaaccaccattgtggacggcttttatgctgacgcgtccagaatgtactgcatcgggaaggtgtctcctgaagcattaaagctggttcaggttacaaaggagagtgtggatttagctcttaaagaaaccagggcatggggccatttaggagatattggagcagctatttctgaacatatctatgccaatggttttacggtggtaagggaaatcggcggacacggcgttgggctggatttccatgaagagccatgggtcagccacatcggtacaagagggaccgatatgcttttagtacccgggatgatatttaccattgagccgatggtaaatgccggaaaggctgacgtggtgcaggatgacgaggatgggtggaccatttacacaagggatggaagtctgtctgcccagtgggagtatacaattttgattacagaagagggtccggaggtgctggcaagataaatggagaaaaaacgttgtatttgggtggatgaaacctccccggtctatgtgaaatatcacgacgaggagtggggagtgccggtttatgatgatgagaagctctatgaaatgcttcttttagaaacctttcaggcaggactttcctggattaccatactgagaaaaagagaggctttccgtcaggcctttgatggttttgatgcggaaaaagtggcatgctacggagaggaaaaactaaaggctttaatggagaatgcggacatcatcaggaaccggaaaaagctggaggcggccgtgaaaaatgcccgtgtgtttttggagatccagcgggaattcggctcattctccaggtatttatggggatttactaacaatgaggtcatcgtcagccgggatgacagctttccggtgaaaacggagctgtccgaccgggtttcaaaggatatgaaaaagagaggaatggcctttgtaggttctgttaccatatattcctatcttcaggcagtgggtgtggtcaatgaccacgaactttcctgcttttgcagaaaggcaacggagaaaaaacaggaggagtgaaataaggaaaagcggggtattatttgataagagagtacatagcctgtgaaataagaggttaataaaaataaggctgcatccggaaaatgtaatttttattggaaaattttacaaattgtggtaaaatgttaaatatttattacgataaacacctgaaaccataaagaaagtgaacgggagtattatgaaaagatggcttttggcagtgattgcattttcgttggtgacctccggatgcagcaggtataagggaattcctgaactctcagagacagacagcaaaacagaagaatctcagcagagtgcagaggaatccgggcagagcacaggggaaaacggcggccagcttcccctggaagcttccgccgtaccgggaaagaagccggtaaaggtaaagggaatctatatttccggctacatggccggctctgagggcctccaggcgattttggacaagatccagggcacggagatcaatactgtggtcattgacgtaaagaatgacgacggaaggatcacctttgccatggaggatgcacctactgtaaatgagatcggtgccacagaaaagtacatcaaagacatagacagcctgatggcccagttaaaggccagggggctttataccattgcccgggttgtggccttccgggatccttatctggccgagaaaaagccggagtggggccttaagaacaaggatgggagtctgcacagggataataagggactggcctgggtgaacccttacaggacggaagtgtgggactacttagtagaggtgggaacccaggcttccaaggccggatttgatgaggttcagtttgactacatccggttctccaccgacagttccatgaaacaggtagtatttgatgatgaggataccaggggccgttctaaaacggacatcattacggaattcatccaatacgcttatgaaaagctttcttctcagaatatttttgtttctgcagatgtgttcgggaccatcatcggaagcaaggtggacgcagaggcagtgggacaaatctatcatgaaatggccggccatctggattatatctgccccatgatctacccttcccattacggagacggaaactttggaattgaccacccggatatggagccttaccgcaccatccgggctgctttgaagctgtcaaagcaggatctggaatccgcaaaagaggctggaaagcatcaggccattgtccgcccctggctccaggatttcacagcttcctatctgaagaactatattccttacggagcgaaggagatcagggcccagatccaggcggtttatgatgcaggctatgatgagtggatcctttggagtgcttccaaccggtatacatgggatggctttttgactgctgaagcagccagggaagaggcggaggagcttgccagggtgagagcagcggaagagatgtctgctgcagcttctgctgaagcaaaggaaccgtctactgaagctgccggcgagacaaaggagtcacagcctgagacccggtccgagactcagacagaaggaaaagaagagaaagcaaaaaagagtcttgaggaaagcacagcaggtgaagagacacagccagagacgaaagctgcaaataaaaagaaagccaagcctgatgtagtcattgtgaccacaggcggccagggaaattaggaagtgagggaagccatggacagaacgcccagaccaggagatttctaccggcattttaaggacaagatgtatcaggtgatagctgttgcggttcattcggaaacaggagaagaaatggtagtatatcaggcgctgtacggatcctttgggatttacgtacgccctctgcccatgttcatcagcgaggtggacaaggagaagtatcccgatgcaaagcagaaatacagatttgaaaaggtggatatgggttctgcggagcgaaaggaaaaggactgtacccaggaatcggaaatagaggacaaggagccctctgtggactgtgtccaaagccaggaaggcgggtcctctgatccttgtcttcacgaaaacaaaaatcttcttgcatttcttgacgctgggacgtatcatgagaagttggaggttcttgaggagcggaaggaccgtttttccgcggaagagcttctggccatctgcgagattatggaaatcggaaggccggattctgaacctgaagagaaatattatgcagtgaaaaggtatttagaactgcagtataaatacgagggagcaagattgaggtgatttgtttcagtggaccacaggtcgtttaatatagaagaagaattaaaaaaactgccgtcccagcctggcgtgtatctcatgcacgataagcgggacgaaattatctatgttggaaaagccatcagcttaaaaaacagggtcaggcagtattttcaaagcagcagaaataaaacggcgaaaatcgaacaaatggtgtcgaggatcgcccggtttgaatacattataacagactctgagctggaagcccttgtgctggaatgcaatctcattaaggagcaccgtccccgttacaataccatgctaaaggatgataagacctatccctatatcaaggtaaccgtgtacgaggactatcccaggattttgttttccagggatatgaaaaaggataaaagcaagtattttgggccgtataccagtgcaggagcggtaaaggataccatagaactgattcataagctttaccagatcaggacctgcaaccggaacttaccaagggacatcgggaaggaacgcccctgcttaaattaccatatcaagcagtgttccgctccgtgccaggattatatcagcaaggaaggatactggcagtccattaataaggctctggactttttaggcggaaaatacggaccagtcataaaaatgctggaagaaaagatgcagtccgcatcagaggaaatggattatgaaaaggcaattgagtaccgggatctgttaaacagtgtcaggcagattgcccagaagcagaagatcactgacagcggcacggaagaccgggatatcattgccatggcaaaggatgaaaaggatgcggtggtttccgtattctttgtcagggaaggcaggctcatcggccgggagcatttccacgtaagcatagcaacggcagaggataacagccagatcctgaccagctttgtgaaacagttttatgcagggactccttttattccaaaggaactgtgggtacagtcaggacttgaggatgaaggtgtcataggagagtggctttctgcaaaacgcgggcagaaggtgaagatcgtggttccgcggaagggccagaaagaacgtctggtggagctggcggaaaaaaatgccgcgcttgtcctgtcccaggataaggaaaagatcaagcgggaagagctccgcaccatcggagcaatgaatgaggtgggcggctggcttgggctttccggcattaagcggatcgaggcctttgatatttccaacatcagcggctttgagtctgtgggctccatgatcgtctatgaagacgggaagcccaagagaaatgattacaggaaatttaagatcaaatgggtcaagggagccaatgattatgcttccatgaacgaggtgcttacaagacggttttcccatggccttcaggaagcggagagcctgaaagaaaagggcgtggatgaggagtttggaagcttcacccgtttcccggacttaatcatgatggatggcggacggggccaggtaaacattgccctggaggtactaagggcgctggatatttccatccctgtctgcggcatggtaaaggatgataaccaccggaccagagggctatactataataacgtggaaattcccattgacaaacattctgaaggctttaaactgattaccagggtccaggatgaggcccaccggtttgccattgagtatcacagaagcttaagaagcaaaggacaggtgaaatccattctggacgacattcccggcatcggccccaacaggagaaaggcgctgatgcgccggtttaaagggctggaggcaatcaaggaagccaccttggaggagctttcccagaccccaggcatgaatgccctggcagcgaagagcgtttatgagttcttccacatatagcttttcaaaatacgaaatctgtgttagtatgaaaaaaacagatggaaaaaaggagcgtacgccatgcatggagtagccataacagatttgattaagaagatgaatttccggaatatgactccggagattgatgcggaaaaaattgtgctcagccatccggatgtaaaccgtccggctttgcagctggccggcttttatgatcattttgacaacgaacgggtgcaggtcatcggttatgtggaacaggaatatatcaatcagatgaatcatgacagaaagcttgagatgtacgacaggcttttgtccagccagatcccatgtctggtatacagccgcagccaggctcctgatgaggatatactggcattctgcaaccattacggcgtgccgtgtcttgtgtctgataagaccacttctgatcttatggcggagatcatccgctggcttaaggtgaagctggcgccctgtatcagcattcacggggttttggtcgacgtattcggtgaaggcgtgctgatcatgggagagagcggcatcggaaaaagcgaggcggctctggagcttattaaaagaggtcaccgtcttgtgaccgatgatgtagtggaaatccgcaaggtaagtgatgagacgctcattggaagcgctccggaaattaccaggcattttattgaattaagaggcatcggcatcattgatgtcaaaactctgttcggtgtggagagcgtaaaggatactcaggccattgatatggtgatcaagctggaagactgggatagagataaggaatatgacaggatgggaatcgaggaccagtatacggaattcctggggaaccgggtggtatgtcattccattccggtacggccgggacgtaatctggccattattgttgaatctgctgcagtcaattacagacaaaagaagatggggtacaacgcggctcaggaattatacaaccgcgtccaggcaaacctttcaagaaaacaggatgattgaggtgtctgatgactggattttatgaaaaacttcttggtgcagccgataaggaccatataaaagttggggaagagatgcgaaagcatacctcgttccgggtgggcggccctgccgcctgctttgtaactccggcggatgagaatgagcttgctgctgttattgttctctgccgaagggaagaggtgccttttttcatacttggcaatggaagcaatcttttagttggggatgaaggctttgaaggcgtggtcatttccatggatagcttttccgggtgtcaggtggataaggagacagggatcgtgaaggcaggagccggagcatccttaaaacggattgcgctggaagcatataaggcttcattgaccggctttgaatttgcagccgggatacccggcacccttgggggagctgtggtgatgaatgccggagcctatggttcggagatgaaggaggttttaaagtctgtcaaagttttgacaaccaggggagaagtacgggaactgcctgtttctgagctttctctggggtaccggaccagttgtattataccaaagcagtatattgtgctggaggctaagatccgcttaagagatggagatgagatttccattaagaaccggatggatgagctggcgcggagaagaaaagaaaaacagcctttggaatatccaagcgctggaagcacctttaagaggccggaagggcattttgccggcaagcttatagaggaggccggattaagagggttttctctgggcggagcccagatttcggagaagcactgcggatttgtcattaacaaggaaaacgctactgcggctgacatcaggaacctgtgtgaagaagtgaaaaaaagggtgcttaagaattccggcgtggcccttgagatggaggtaaagacactggggaagttttaacggtgcaaaggagaacaatgtgaggctagtcattgtaacaggcatgtcaggcgcgggaaagacccaggcgcttaaaatgctggaggacatggggttttactgtgtggataatcttcccattcccctgattgaaacatttgcggagctgaccctgagcaatcatgcagggatcaggaacgcggctttagggattgatatccgcagtggggaggatttgtcggttttaaacaggatttttgatgaatggtcaagaaaacgaatgcattttgaaatcctattccttgacgcaggggatgagacgctgatcaaacgctataaggaaaccaggagggcccatcccctggcggcaggaggcaggatcgacagcgggatcgaaaaggaacgggtaaaactggcgtttttaaaggaagaagcggattatatcatagataccagccgtcttcttacaaaggagctgaggcaggaactggaaaaaatatttgtaaaccgggaatcctaccggaacctgtacatcaccatcctttcgtttggattcaaatatggaattccgtcggatgcggatctggtatttgatgtaaggtttctcccaaatccctactattcagaggaactgcggcctaaaaccggagaagaaaaagaagtgcgggactatgtgatgcagcatgggaccgctgccctgtttttagacaagctttatgatatgctggaatttttaattcccaactatgtgctggagggaaaaaaccagctggtggttgccatcggctgtacaggaggcaagcaccggtcagttaccattgccaggtcggtttatgaccggtttaagtccagagaagcatttgggataaagatggaacaccgggacatcgacaaggacaatacacggaaaaggatggtctagatatgtcattttcttccaaattaaaagaagagctttccagacaaatcagtccggcaaggcattgccagatcgcggagatggctgcgatcatcagtctttgcggaaaaataatcatatccgaagacgactgttatacaattaaaataaatacggaaaatgtggcagttgcaagaaagtactttacattattgaaaaaaacatttaatataagtactgatgtgtccattagaagaaatgcctatttaaataaaaaccgtacttacacggtgaccatcagggagcatgaggaggccatccgggttttgcacgccacaaagcttcttgatgaaaacggagaaattggggaaaacttaaatcctgtaaggaatgtggtcatccagcagtcctgctgcaggagagcgttcatccgcggcgcgtttctctcttccgggtccttaagcgaccctgaaaaattttaccattttgaaatcgtatgtgccacagaagaaaaggcagagcagctaaaatctattatcgggacctttgaccttgaagcaaaaattgtgaagaggaagcgctattttgtggtttatataaaagaaggaagccagattgtggatatcctgaatgtgatggaggcgcccgtgtctttgatggagcttgaaaacatcaggattttaaaggatatgcgaaacagtgtgaaccggcaggtcaactgtgaaactgccaatattaataaaacggtatcagctgcggtaaagcagatagaagatataaaatatatcagagatacaatcggacttgataatcttccggacaatctaagtgaaattgccagggaacgattggaaaggccggaagcaacattaaaagagcttggagaagctctggaccctcctgtaggcaaatcaggagtgaaccaccgacttagaaagctttgcgacctggcagggcgactgcgcgggacaggcgtgagcagcggaatggaatagatctgttcataggaatgaggaggataattatggtaagaaaaacagtcaccgttgaacttgcatcaggtttagaggcaagaccagttgctatgctggttcaggttgccagccagtatgaaagcaacatttatgttgagatcgaatccaagagagtaaatgccaagagtatcatgggtatgatgactctgggacttgcagcgggagagcagattacgatcactgcggatggtacggatgaagagcaggcgattgccga
